(12) United States Patent
Rouy et al.

(10) Patent No.: US 9,301,975 B2
(45) Date of Patent: Apr. 5, 2016

(54) METHOD OF PREPARING AUTOLOGOUS CELLS AND METHOD OF USE FOR THERAPY

(75) Inventors: Didier Rouy, San Carlos, CA (US); Peter A. Altman, San Carlos, CA (US); Benjamin Koziner, Buenos Aires (AR)

(73) Assignee: Biocardia, Inc., San Carlos, CA (US)

( * ) Notice: Subject to any disclaimer, the term of this patent is extended or adjusted under 35 U.S.C. 154(b) by 808 days.

(21) Appl. No.: 12/434,537

(22) Filed: May 1, 2009

(65) Prior Publication Data
US 2010/0278783 A1 Nov. 4, 2010

(51) Int. Cl.
| | | |
|---|---|---|
| C12N 5/00 | (2006.01) | |
| A61K 35/00 | (2006.01) | |
| A61K 35/10 | (2015.01) | |
| C12N 5/0775 | (2010.01) | |
| A61K 35/12 | (2015.01) | |
| C12Q 1/68 | (2006.01) | |

(52) U.S. Cl.
CPC ............. *A61K 35/00* (2013.01); *A61K 35/10* (2013.01); *C12N 5/0663* (2013.01); *A61K 2035/124* (2013.01); *C12N 2500/84* (2013.01); *C12N 2502/11* (2013.01); *C12Q 1/6883* (2013.01); *C12Q 2600/106* (2013.01); *C12Q 2600/156* (2013.01); *C12Q 2600/158* (2013.01)

(58) Field of Classification Search
CPC ....... A61K 35/00; A61K 35/10; C12N 5/0663
See application file for complete search history.

(56) References Cited

U.S. PATENT DOCUMENTS

| | | |
|---|---|---|
| 6,261,549 B1 | 7/2001 | Fernandez et al. |
| 6,281,012 B1 | 8/2001 | McIntosh et al. |
| 6,322,784 B1 | 11/2001 | Pittenger et al. |
| 6,328,960 B1 | 12/2001 | McIntosh et al. |
| 6,342,370 B1 | 1/2002 | Connolly |
| 6,355,239 B1 | 3/2002 | Bruder et al. |
| 6,358,702 B1 | 3/2002 | Connolly |
| 6,368,636 B1 | 4/2002 | McIntosh et al. |
| 6,379,953 B1 | 4/2002 | Bruder et al. |
| 6,387,367 B1 | 5/2002 | Davis-Sproul et al. |
| 6,387,369 B1 | 5/2002 | Pittenger et al. |
| 6,541,024 B1 | 4/2003 | Kadiyala et al. |
| 6,685,936 B2 | 2/2004 | McIntosh et al. |
| 6,709,864 B1 | 3/2004 | Pittenger et al. |
| 6,761,887 B1 | 7/2004 | Kavalkovich et al. |
| 6,797,269 B2 | 9/2004 | Mosca |
| 6,835,377 B2 | 12/2004 | Goldberg et al. |
| 6,863,900 B2 | 3/2005 | Kadiyala et al. |
| 6,875,430 B2 | 4/2005 | McIntosh et al. |
| 7,029,666 B2 | 4/2006 | Bruder et al. |
| 7,101,704 B1 | 9/2006 | Mosca |
| 8,496,926 B2 | 7/2013 | De La Fuente et al. |
| 2003/0103951 A1 | 6/2003 | Pittenger et al. |
| 2005/0112104 A1* | 5/2005 | Pittenger et al. ............ 424/93.7 |
| 2005/0265980 A1* | 12/2005 | Chen et al. ................... 424/93.7 |
| 2006/0003365 A1 | 1/2006 | Shaughnessy et al. |
| 2007/0037144 A1 | 2/2007 | Wohlgemuth et al. |
| 2008/0111272 A1* | 5/2008 | Burgess et al. ............... 264/165 |
| 2009/0035286 A1 | 2/2009 | Minguell et al. |
| 2009/0148415 A1 | 6/2009 | de la Fuente et al. |
| 2010/0166712 A1* | 7/2010 | Sadiq et al. ................... 424/93.7 |
| 2010/0240665 A1 | 9/2010 | Eckhardt et al. |

FOREIGN PATENT DOCUMENTS

| | | |
|---|---|---|
| WO | WO 99/57130 A1 | 11/1999 |
| WO | WO 2008/023566 A2 | 2/2009 |
| WO | WO 2009/033162 A1 | 3/2009 |

OTHER PUBLICATIONS

Da Silva Meirelles et al (Frontiers in Bioscience 14:4281-4298, 2009).*
Li et al. Stem Cell and Development 15:697-705, 2006.*
Garcia-Olmo et al. Dis Colon Rectum 48(7);1416-1423, 2005. Abstract only.*
Strauer, el al., Regeneration of Human Infarcted Heart Muscle by Intracoronary Autologous Bone Marrow Cell Transplantation in Chronic Coronary Artery Disease, 46 J. Am. Coll. Cardiol. 1651 (2005).
Vandervelde, et al., Stem Cell-Related Cardiac Gene Expression Early After Murine Myocardial Infarction, 73 Cardiovascular Research 783 (2007).
Chachques, et al., Cellular Cardiomyoplasty: Clinical Application, 77 The Annals of Thoracic Surgery 1121 (2004).
Kobayashi, et al., Motility and Growth of Human Bone-Marrow Mesenchymal Stem Cells During Ex Vivo Expansion in Autologous Serum, 87-B Journal of Bone and Joint Surgery 1426 (2005).
Lange, et al., Accelerated and Safe Expansion of Human Mesenchymal Stromal Cells in Animal Serum-Free Medium for Transplantation and Regenerative Medicine, 213 Journal of Cellular Physiology 18 (2007).
Mizuno, et al., Human Autologous Serum Obtained Using a Completely Closed Bag System as a Substitute for Foetal Calf Serum in Human Mesenchymal Stem Cell Cultures, 30 Stem Cell Biology International 521 (2006).
Shahdadfar, et al., In Vitro Expansion of Human Mesenchymal Stem Cells: Choice of Serum is a Determinant of Cell Proliferation, Differentiation, Gene Expression and Transcriptome Stability (2007), available at http://www.StemCells.com.

(Continued)

*Primary Examiner* — Marcia S Noble
(74) *Attorney, Agent, or Firm* — Wilson Sonsini Goodrich & Rosati (57) ABSTRACT

A method for expanding mesenchymal cells derived from autologous bone marrow in autologous culture medium which can be used in a clinical setting, and a business method for performing such expansions in the future as a service for patients. A method for expanding mesenchymal cells derived from autologous bone marrow in autologous culture medium including a diagnostic kit for the autologous cell therapy to determine whether a patient will respond to the autologous cell therapy for treatment of a disease, in which said kit comprising a system for detecting gene and protein expression comprising at least two isolated DNA molecules wherein each isolated DNA molecule detects expression of a gene that is differentially expressed in the tissue of the patient that is intended to be the source of the autologous cell therapy.

10 Claims, 4 Drawing Sheets

(56) References Cited

OTHER PUBLICATIONS

Deng, et al. Noninvasive discrimination of rejection in cardiac allograft recipients using gene expression profiling, Am J Transplant. Jan. 2005;6(1):150-60.

European search report and written opinion dated Feb. 1, 2011 for EP Application No. 10770479.3.

Hattan, et al. Purified cardiomyocytes from bone marrow mesenchymal stem cells produce stable intracardiac grafts in mice. Cardiovascular research, Oxford University Press, GB, vol. 65, No. 2, Feb. 1, 2005, pp. 334-344.

International search report and written opinion dated Feb. 1, 2011 for PCT/US2010/033378.

Leri, et al. Myocardial regeneration and stem cell repair. Current Problems in Cardiology, Year Book Medical Publishers, Chicago, US, vol. 33, No. 3, Jan. 31, 2008, pp. 91-153.

Ming Zhang, et al. SDF-I expression by mesenchymal stem cells results in trophic support of cardiac myoctyes after myocardial infarction. Faseb Journal, Fed. of American Soc. for Experimental Biology, US, vol. 21, No. 12, Oct. 1, 2007, pp. 3197-3207.

Segers, et al. Stem-cell therapy for cardiac disease. Nature, vol. 451, Feb. 21, 2008, pp. 937-942.

Strauer, et al. Renegeration of human infarcted heart muscle by intracoronary autologous bone marrow cell transplantation in chronic coronary artery disease. J Am Coll Cariol 46: 1651-58.

Vandervelde, et al. Stem cell-related cardiac gene expression early after murine myocardial infarction0 Cardiovasc. Res., vol. 73, No. 4, pp. 783-793, Mar. 1, 2007—See figures 3-5; Abstract.

\* cited by examiner

|  |  | CD13 | CD105 | CD90 | CD14 | CD45 | CD44 | CD34 | CD61 | CD73 |
|---|---|---|---|---|---|---|---|---|---|---|
| Patient 1 | FCS | 98.5 | 96.2 | 99.4 | 0.3 | 0.7 | 98.1 | 0.1 | 0.4 | 97.8 |
|  | AS | ND | 73.8 | 74.6 | 26.5 | 24.4 | ND | ND | ND | 61.2 |
|  | F&T PRP | 99.3 | 99.5 | 99.6 | 1.3 | 1 | 99.2 | 0.1 | 0.3 | 89.2 |
|  | tPRP | ND | 96.5 | 94.7 | 4.7 | 0.4 | 78.2 | 0.2 | 0.3 | 99.5 |
| Patient 2 | FCS | 99.4 | 99.4 | 99.1 | 0.9 | 1.8 | 99.2 | 0.8 | 0.3 | 99.3 |
|  | AS | 99 | 99 | 99.3 | 0.6 | 4.1 | 96.8 | 1.2 | 1.9 | 99.5 |
|  | F&T PRP | 99.7 | 99.6 | 99.1 | 0.2 | 3.3 | 93.8 | 0.1 | 2.1 | 99.7 |
|  | tPRP | 99.8 | 99.4 | 99.7 | 0.7 | 5.5 | 98.4 | 0.1 | 2.4 | 99.6 |
| Patient 3 | FCS | 99.0 | 99.5 | 99.4 | 0.5 | 4.5 | 98.4 | 0.6 | 0.1 | 99.4 |
|  | AS | 97.1 | 98.0 | 98.1 | 3.5 | 7.1 | 98.1 | 1.2 | 0.2 | 95.6 |
|  | F&T PRP | 98.9 | 98.4 | 99.1 | 0.8 | 6.2 | 95.4 | 0.4 | 2.2 | 97.1 |
|  | tPRP | 98.7 | 98.9 | 99.4 | 2.0 | 2.0 | 99.4 | 1.5 | 0.6 | 98.2 |
| Patient 4 | FCS | 97.9 | 97.5 | 97.7 | 2.8 | 6.6 | 95.4 | 2.1 | 2.4 | 84.6 |
|  | AS | 98.2 | 98.4 | 97.2 | 6.4 | 5.3 | 98.9 | 0.7 | 3.9 | 95.8 |
|  | F&T PRP | 99.6 | 98.9 | 99.4 | 1.0 | 4.0 | 96.2 | 0.1 | 0.7 | 99.0 |
|  | tPRP | 98.1 | 99.5 | 98.4 | 2.2 | 0.8 | 97.5 | 0.2 | 0.3 | 97.2 |
| Expected in | MSCs | 100 | 100 | 100 | 0 | 0 | 100 | 0 | 0 | 100 |
|  |  | * | * | * | * | * |  |  |  | * |
| Known in: |  | stem mono Mac Epi endo | Stem Endoth | Stem Endoth | Mono Mac Granulo | Lympho stem Mono/mac Granulo | All | Stem Endot | Mono/mac Plate Endoth | Lympho Stem Endoth Epit |

METHOD OF PREPARING AUTOLOGOUS CELLS AND METHOD OF USE FOR THERAPY

FIELD OF THE INVENTIONS

The inventions described below relate the field of autologous cell therapy.

BACKGROUND OF THE INVENTIONS

In our prior U.S. patent application Ser. No. 11/735,869, filed Apr. 16, 2007, we described a treatment for patients suffering from chronic myocardial infarction by injecting autologous bone marrow cells in or near the areas of chronic myocardial infarction in the patient's heart. In addition to the mononuclear cells, mesenchymal cells, CD-34 positive cells, CD-90 positive cells, and CD-133 positive cells mentioned in therein, additional cell therapies may be applicable to other cardiac conditions. Each of these cell therapies may be useful to treat chronic myocardial infarction, acute myocardial infarction, myocardial ischemia, chronic myocardial ischemia, heart failure, cardiovascular disease, and peripheral vascular disease. U.S. patent application Ser. No. 11/735,869, U.S. is hereby incorporated by reference.

Human bone marrow mesenchymal cells (hMSCs) are currently being investigated for a number of clinical applications including cardiovascular repair, orthopaedic repair, connective tissue repair, and immune diseases such as graft versus host disease, Crohn's disease. They have potential roles in other immune diseases such as lupus, osteoarthritis and rheumatoid arthritis as well as well as diabetes. They also have potential to act as carriers of gene-based therapeutics with ex vivo transfection of the cells to enhance the control of gene based therapeutics dosing. The following prior art references are hereby incorporated by reference: U.S. Pat. Nos. 7,101,704; 7,029,666; 6,875,430; 6,863,900; 6,835,377; 6,797,269; 6,761,887; 6,709,864; 6,685,936; 6,541,024; 6,387,369; 6,387,367; 6,379,953; 6,368,636; 6,358,702; 6,355,239; 6,342,370; 6,328,960; 6,322,784; 6,281,012; 6,261,549.

Although it has been argued that allogenic cells have great potential to provide an off the shelf product for patients because they will not be recognized as foreign by the recipient patient, this has not yet been proven. Allogenic cells have a greater propensity (compared to autologous cells) to carry diseases from the donor to the recipient and have a greater propensity for rejection of the therapeutic cells by the immune system of the patient who received them.

Expansion of autologous hMSC in a truly autologous culture medium that contains no animal serum or allogenic culture additives for clinical transplantation to the patient, which has not previously been proposed, should also be valuable avoiding the problems associated with allogenic cells. To date, reported clinical trials are employing human bone marrow mesenchymal stromal cells generated in a culture medium supplemented with fetal calf serum (FCS). FCS is an undesired source of xenogeneic antigens and bears the risk of transmitting animal viral prion and zoonose contaminations. Additionally FCS has been implicated with anaphylactic or arthus like immune reactions in patients who received cells generated in FCS supplemented medium even leading to arrhythmias after cardioplasty (Chachques 2004).

Early work on autologous serum hMSC has recently been shown to be promising by Stute et al 2004, but the amount of autologous serum required is identified as a significant hurdle to clinical expansion such that the investigators proposed using 1% and 3% autologous serum in the culture medium even though they had far superior results at 10% autologous serum. Other investigators have also shown a faster proliferation compared to FCS at least during first passages without loss of the typical phenotype, motility, and differentiation capabilities in vitro, whereas allogenic human serum resulted in hMSC growth arrest and death (Kobayashi et al 2005, Shandahar et al 2005, Mizuno et al 2006).

The primary reason presented that autologous serum cannot be considered as a general substitute for FCS is the amount of autologous serum necessary for sufficient expansion would exceed the amount a donor could provide (Lange et al 2007). Lange et al 2007 proposed the use of pooled platelet lysates to create an activated plasma to avoid the use of FCS, but their solution falls short of that provided here in that they are pooling the platelets from multiple donors to create an allogenic culture medium.

Here we disclose three methods to culture bone marrow or adipose tissue derived autologous culture medium expanded autologous mesenchymal stem cells (ACMEAM's) from the bone marrow or adipose tissue. These inventive methods have enormous value and have been validated in both a swine and human and are comparable to the gold standard of culturing in 10% fetal calf serum.

SUMMARY

The methods and devices described below provide for treatment of several cardiovascular diseases with autologous culture medium expanded autologous mesenchymal stem cells (ACMEAM's) from the bone marrow. To treat a patient with the various cardiovascular diseases, including chronic myocardial infarction, myocardial ischemia, acute myocardial infarction, congestive heart failure, atherosclerosis, coronary artery disease, and peripheral artery disease, blood components and a source of MSCs (typically bone marrow or adipose tissue stromal cells) are extracted from the patient. Autologous culture medium is prepared from the blood components and the extracted MSCs are expanded to create ACMEAMs over a period of weeks for subsequent characterization and administration to the patient. The cells are expanded in the autologous culture medium developed from the blood components as described. When sufficient population of expanded cells has been grown, the cells are administered to the patient from whom they were harvested, in or near the site of the disease to be treated.

These therapies are extremely expensive, perhaps $10,000 to $50,000 per therapeutic dose of approximately 20 to 100 million cells delivered in a volume of 1.0 to 5.0 ml which is typically, but not necessarily, used in a single session of tissue injections.

DETAILED DESCRIPTION OF THE INVENTIONS

Three separate preferred methods for creating autologous culture medium are provided. These involve adding to a base medium one of the following three (1) autologous serum at 10% by volume, (2) activated plasma developed from thaw freeze platelet lysates at 5% by volume, and (3) activated plasma made by thrombin activation at 5% by volume.

(1) ACMEAMs in Autologous Serum

The treatment method starts with harvesting both blood from the patient, and harvesting stem cells from the patient. It has been noted in the literature that the generation of autologous serum for culturing is difficult in that many patients cannot provide sufficient blood to enable expansion of the stem cells from the patient in the serum from the patient. The solution here on the surface will appear quite simple, but it is not the preferred embodiment of this invention as it is far more complex clinically than the other two solutions.

The problem that makes autologous serum not a solution for patient therapeutics is that many patients, particularly those with a significant cardiovascular disease, cannot donate sufficient blood in a single visit to enable successful cell growth. This problem of obtaining enough autologous serum in a single visit to culture cells, is solved by having them donate the tissue for culturing on multiple separate occasions with a sufficient time lag between the blood harvest for them to have regenerated. In this invention, the patient's own serum will be used to avoid fetal calf serum and provide for autologous serum to grow mesenchymal cells taken from bone marrow. To obtain this serum, 250 ml of blood will be taken from each patient at each of two visits separated between one and three weeks apart for a total blood volume of 500 ml of blood. This blood will be stored as a source for autologous tissue culture medium. This type of thinking goes against typical medical practice as one desires to have the patient see the physician as little as possible, and spend as little time as possible within the hospital. Physician and hospital time is expensive. The additional time to generate the autologous serum also slows the delivery of therapy which is also not desirable. Further, having multiple tissue harvest points requires additional control in tracking the blood volumes that will be used to form serum as well as the cell source from which the mesenchymal cells will be expanded. However donating blood products at two or more time points before the therapy does provide a solution to generating autologous serum.

The disadvantage of the delay in cell processing could be addressed by continuing to harvest tissue during the culturing process as the need for autologous serum increases exponentially over time with the expansion of the cultures. Although this is theoretically feasible, it makes no sense from a manufacturing process perspective as many logistic issues could result in a lack of inputs at critical periods during the culture process.

Figure 1:
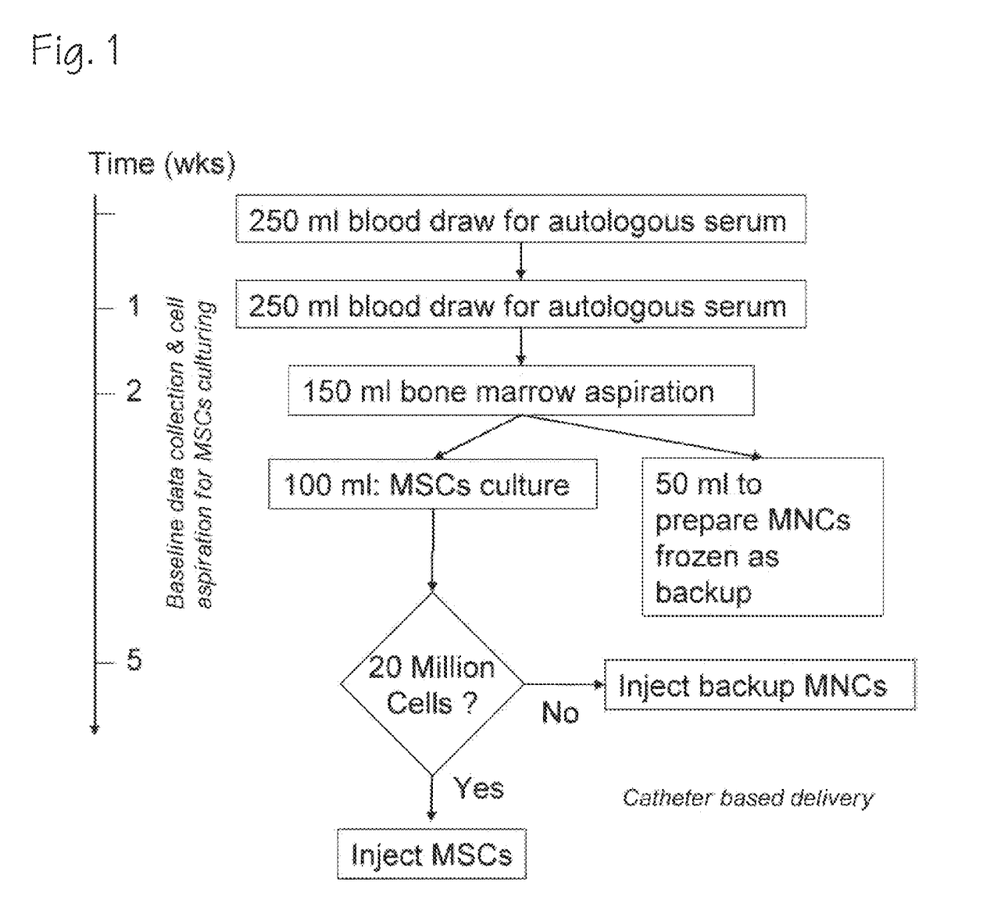
FIG. 1 illustrates a method for preparing autologous culture medium expanded autologous mesenchymal stem cells (ACMEAMs) from the bone marrow.
Figure 2A:
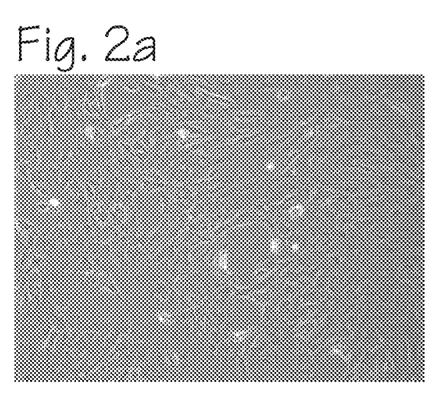
FIGS. 2a through 2d show comparative photographs of Swine mesenchymal stromal stem cells taken from the bone marrow and cultured for 18 days in (FIG. 2a) 10% fetal calf serum, (FIG. 2b) 10% autologous serum, (FIG. 2c) 5% platelet rich plasma where platelets were lysed with a freeze thaw cycle, and (FIG. 2d) 5% platelet rich plasma where platelets were lysed with a thrombin activation.
Figure 2B:
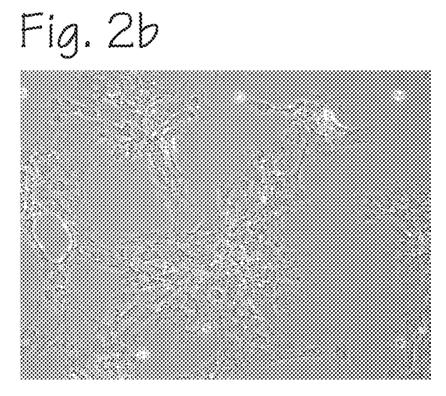
Figure 2C:
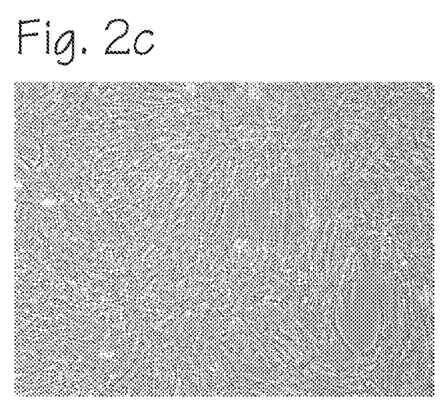
Figure 2D:
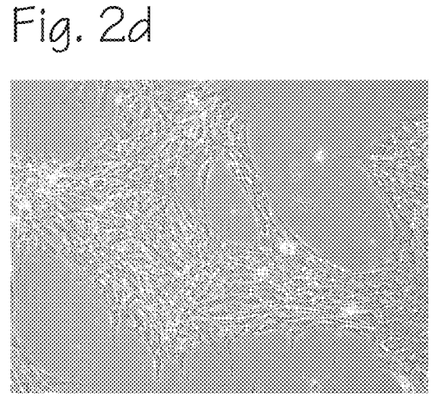
Figure 3A:
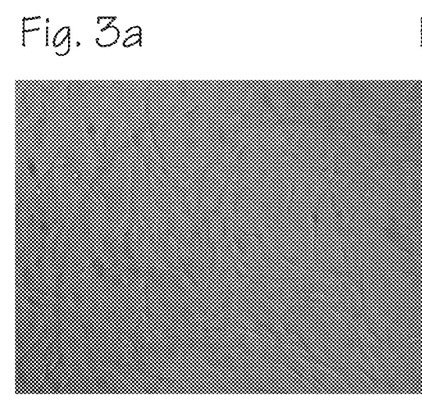
FIGS. 3a through 3d show comparative photographs of Human mesenchymal stromal stem cells taken from the bone marrow and cultured for 11 or 13 days in (FIG. 3a) 10% fetal calf serum, (FIG. 3b) 10% autologous serum, (FIG. 3) 5% platelet rich plasma where platelets were lysed with a freeze thaw cycle, and (FIG. 3d) 5% platelet rich plasma where platelets were lysed with a thrombin activation.
Figure 3B:
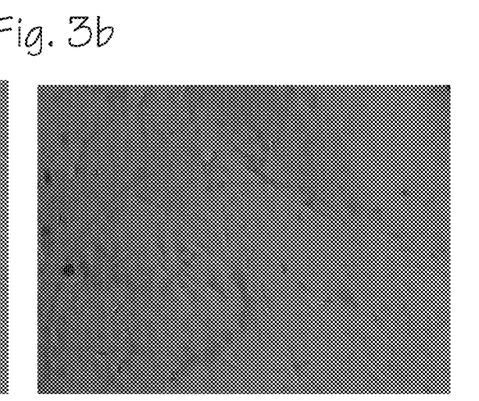
Figure 3C:
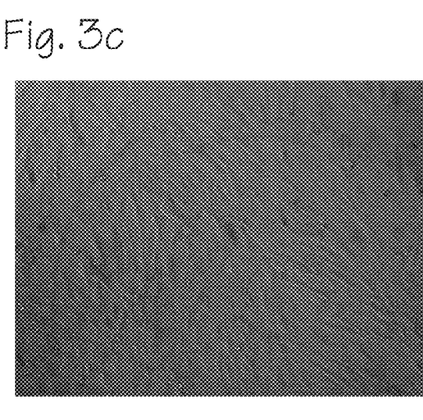
Figure 3D:
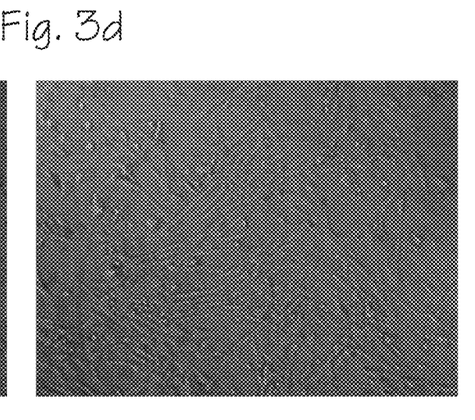

FIG. 1 shows this method and neatly solves the hurdle of both enabling the development of autologous serum to expand ACMEAMs as well as a fall back strategy to deliver a preparation of MNCs should the ACMEAMs not culture as expected. Patients will have up to 150 ml of bone marrow aspirated under local anesthesia. Up to 100 ml will be used to expand the mesenchymal cell population in this autologous serum to develop a dosage of up to 100 million MSCs, with a minimum of 20 million MSCs. Patients who are not eligible for MSCs due to difficulties in culturing a minimum of 20 million MSCs may be eligible to receive frozen MNCs at a dosage of 100 million cells which is the same dosage previously delivered by our group in a clinical setting with good results.

In this invention, 250 ml of blood will be taken from the patient to obtain autologous serum roughly five weeks before therapy is scheduled and an additional 250 cc will be taken roughly four weeks before therapy to provide for 500 cc of blood to provide for autologous serum. Roughly three weeks before therapy (such as cardiac catheterization for delivery in a setting of heart failure) 150 ml of autologous bone marrow mononuclear cells will be aspirated under local anesthesia from the posterior iliac crest. Bone marrow mononuclear cells will be isolated by density gradient on Ficoll-Paque Plus tubes (Amersham Biosciences). Cells will be washed and filtered through 100 µm nylon mesh to remove cell aggregates.

The blood and bone marrow are transported to a laboratory for processing, including separation of the mesenchymal stem cells from the bone marrow, and culturing and expanding a portion of mesenchymal stem cells (while preserving a portion of the mesenchymal stem cells for later use, including re-supply of mesenchymal stem cells should the processed portion fail). The mesenchymal stem cells are expanded until a population of up to 200 million cells is achieved.

Cells are divided into two fractions. One fraction will be cultured in three (3) T225 $cm^{2v}$ Falcon flasks (Becton Dickinson) providing cells that will then be seeded into thirty (30) T225 $cm^2$ flasks to generate up to 200 million P1 cells using the autologous serum. Ten percent of the final cell solution will be used for cell counting and viability testing using trypan blue exclusion and bacteriological analysis. A second fraction will be frozen for future use if the number of cultured hMSCs do not reach the acceptable 20 million level. This second fraction may be used in an attempt to deliver MNCs as shown in FIG. 1 or saved to attempt an expansion of the frozen cells at a later date.

The expanded population of up to 20M cells is then frozen and transported to the medical facility where the treatment is to be performed, and cells are thawed, washed, and re-suspended just prior to delivery at a concentration of up to $4.0 \times 107$ cells/ml in a total volume of up to 5 ml.

(2) ACMEAMs in Activated Plasma with Platelet Freeze Thaw

Blood components (serum, plasma, platelets and their derivatives) are obtained through apheresis according to standard procedure. There are numerous types of apheresis. Blood taken from a healthy donor can be separated into its component parts, where the needed component is collected and the "unused" components are returned to the donor. Fluid replacement is usually not needed in these type of collections. There are large categories of component collections: Plasmapheresis—blood plasma. Plasmapheresis is useful in collecting FFP (fresh frozen plasma). Plateletpheresis (thrombapheresis, thrombocytapheresis)—blood platelets. Plateletpheresis, like it sounds, is the collection of platelets by apheresis; while returning the red blood cells, white blood cells, and component plasma. The yield is normally the equivalent of between six and ten random platelet concentrates. Leukapheresis—leukocytes (white blood cells). Leukopheresis is the removal of PMN's, basophils, eosinophils typically for transfusion into patients whose PMN's are ineffective or traditional therapy has failed.

Apparatus such as Haemonetics MCS+9000 or COBE 2991 with sterile single use consumables are used. After the venous access is secured, the speed is set up to 60 ml/min. A maximum of 15% of the total blood volume is sampled according to the standard tables (i.e. a 75 KG patient has a total blood volume of 5250 ml and 787 ml may be sampled). The red cells are infused back. The whole procedure takes 1-2 hours and yields $10^{11}$ to $5\times10^{11}$ platelets.

The Apheresis produces platelet rich plasma (up to 250 ml) which are split into 50 ml bags using sterile techniques. Bone marrow is processed as before on the same day and sent to the processing lab in the same package with the platelet rich plasma.

At the processing lab, the platelet rich plasma bags are then frozen in liquid nitrogen for 5 seconds and then thawed under 37° C. water and then frozen again in liquid nitrogen. After the second thaw they are transferred into 15 ml falcon conical tubes and frozen at −20° C. These tubes are then thawed for the culture medium and added to the culture base medium alpha MEM from GIBCO at 5% to 10% upon which the mononuclear cells containing mesenchymal cells obtained as described previously are plated out similarly as previously described.

The advantage of this approach is that even with a large marrow aspiration of 150 ml, the total volume loss for the patient is only 150 ml. This can be done on volumes of marrow as small as 50 ml. Further, the procedure for quality control just became enormously simpler as the patient presents at the hospital at one time point and the reagents for cell culture are shipped and processed at the lab at one time point. This is enormously valuable.

(3) ACMEAMs in Activated Plasma with Platelet Thrombin Activation

Platelet rich plasma and autologous bone marrow are obtained and shipped to processing lab on the same day as described previously.

At the processing lab, one unit of thrombin per ml is added to the platelet rich plasma bags containing 150 ml. Thrombin activated platelet rich plasma is then gently shaken for 45 minutes at room temperature, followed by transfer into 50 ml conical tubes and spun to eliminate platelet aggregates. Supernatent is aliquoted in 15 ml tubes and frozen for further supplementing the culture medium. These tubes are then thawed for the culture medium and added to the culture base medium alpha MEM from GIBCO at 5% to 10% upon which the mononuclear cells containing mesenchymal cells obtained as described previously are plated out similarly as previously described. This has the same advantages of the freeze thaw platelet lysate autologous culture medium.

FIGS. 2a through 2d show cultured swine MSCs 18 days after culture with three autologous mediums invented here. Swine mesenchymal stromal stem cells taken from the bone marrow and cultured for 18 days in (FIG. 2a) 10% fetal calf serum, (FIG. 2b) 10% autologous serum, (FIG. 2c) 5% platelet rich plasma where platelets were lysed with a freeze thaw cycle, and (FIG. 2d) 5% platelet rich plasma where platelets were lysed with a thrombin activation. They show very similar characteristic to classic MSC morphology.

FIG. 3a through 3d show human mesenchymal stromal stem cells taken from the bone marrow and cultured for 11 or 13 days in (FIG. 3a) 10% fetal calf serum, (FIG. 3b) 10% autologous serum, (FIG. 3c) 5% platelet rich plasma where platelets were lysed with a freeze thaw cycle, and (FIG. 3d) 5% platelet rich plasma where platelets were lysed with a thrombin activation. They show very similar characteristic re MSC morphology. All cultures remained viable and non-contaminated until the end (4 weeks of culture). Cellularity was good with fetal calf serum and platelet rich plasma with freeze thaw but less optimal with autologous serum or thrombin activation.

Figure 4:
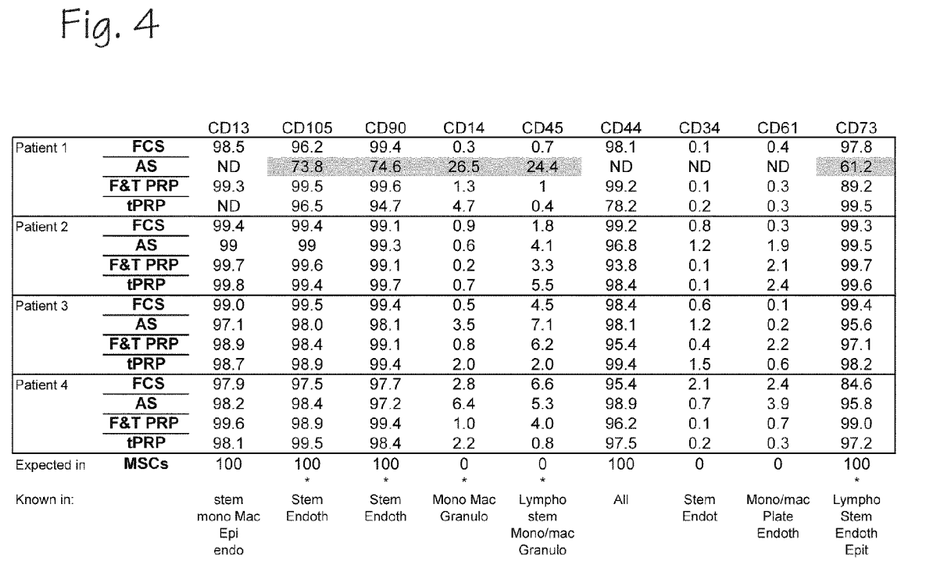
FIG. 4 is a table of CD Profiles in Human Cultured Autologous Bone Marrow Mononuclear Cells in Fetal Calf Serum (FC), Autologous Serum (AS), Freeze and Thaw Platelet Activated Plasma, (F&T PRP) and Thrombin Activated Platelet Activated Plasma (tPRP).

FIG. 4 shows the flow cytometry CD Profiles in Human Cultured Autologous Bone Marrow Mononuclear Cells in Fetal Calf Serum (FC), Autologous Serum (AS), Freeze and Thaw Platelet Activated Plasma, (F&T PRP) and Thrombin Activated Platelet Activated Plasma (tPRP). Profile of cells from the 4 different culture conditions showed a similar phenotype: CD105+, 73+, 90+, 34−/45−−. This experiment on all patients had essentially identical results. The only anomalies are shown in gray in the first patient run. The Row denoted "expected in" shows expected percentage, and on what type of cells the CD is known to be expressed. The five columns with a * are the 5 CDs sufficient to prove that the cells are a form of MSCs.

For therapeutic purposes the cells are then frozen, shipped to the interventional lab and delivered to the patient. For cardiac applications the preferred deliver is transendocardial intramyocardial delivery or surgical direct injection into the target zone. For gastroesophogeal reflux the cells are delivered through a catheter or transesophogeal ultrasound probe having a penetrating needle element into the region of weakening at the stomach-esophagus junction. For Crohn's disease they are delivered via the rectum through a gastrointestinal catheter designed to navigate in this anatomy with a similar penetrating element and distal steerable member.

The cell compositions and suitable delivery catheters can be provided in a combination cell and device therapeutic. A disposable single use catheter having a distal penetrating needle tip for insertion into target tissues, with the distal penetrating element in fluid communication with a fluid port on the proximal end of said catheter may be used for delivery. Using such a catheter, the cell composition is injected interstitially into the tissue. The cells are delivered at a concentration of between 20M and 40M cells per cc at a dosage of between 20M and 200M cells total. The catheter and a reservoir of cells may be packaged at a manufacturing site and shipped as an assembly to a medical facility for immediate use.

The methods described above provide for development of a population of autologous stem cells for treatment of disease, by injection of expanded stem cells into tissue of the patient in or near areas affected by the disease. Development of the population of stems cells is, as described above, accomplished by harvesting blood and its components from the patient, in two or more times separated by a week, and creating a culture medium that is entirely autologous, having no animal serum or allogenic culture additives, but instead being augmented with autologous serum or autologous plasma (activated as described above), and expanding the autologous stem cells in that culture medium.

These and other autologous therapeutic cells all have diagnostic value as well. Because these cells are autologous they hold information about the therapeutic potential of the cell and also about the characteristics of the patient that the cultured cells will be administered to that may reflect their responsiveness to therapy. Central to molecular diagnostics is the tissue that is assayed for biomarkers. Throughout this disclosure, the preferred embodiment of tissue for analysis is blood as it is readily available in all patients at all times, and it carries within it the cells of the immune system which recognize known and as yet unknown diseases. Blood is occasionally the source for cell based therapies, and is in intimate communication with other sources from which cell based therapies may be developed and derived: the bone marrow, the adipose tissue, the heart tissue, the nervous system tissues, the skin, the pancreas, etc. However in this specification, it will be recognized that the cells that are the specific source of the cell therapy will have even greater potential to be characterized for their potency in addition to the patient responsiveness to such a therapy due to genetic makeup.

In addition to the mesenchymal stem cells described here, all autologous cell therapy preparations may benefit from this diagnostic strategy. This includes the autologous bone marrow derived cells and cell populations in development at Aldagen and Aastrom Biosciences, as well as the CD34+ cells derived from blood in development at Baxter Healthcare, the autologous cells derived from Adipose tissue in development by Cytori Therapeutics, and other similar cell based therapeutics. Being able to characterize cells for potency by measuring their gene expression provides a means to avoid expensive and risky interventions for those who are less likely to respond. It also provides a means to optimize and enhance this therapeutic strategy over time. For example, if patients without expression of RNAs that code for angiogenic cytokines is noted, these patients may then be selected to receive a modified therapy that includes an angiogenic cytokine—such as described in the trial described by Losordo in which cells are transfected to express VEGF prior to delivery (ClinicalTrials.gov Identifier: NCT00279539).

Example 1

In a first blood draw before tissue is harvested for therapeutic purposes, the gene expression or proteomic patterns in the circulating blood leukocytes are used to determine whether (and to what extent) the patient will respond to various potential cell therapy preparations. In this setting there are options for the preparation of tissue for analysis including: PreAnalytix Pax Gene tubes which are commercially available to stabilize whole blood RNA, isolation of the leukocytes using gravity centrifugation methods and then preserving these with either a PaxGene tube or freezing these cells on dry ice and ultimately at −80 C, or taking fractions of the blood using flow cytometry to remove subsets of cells using antibody probes for surface markers of interest which may be more relevant to the therapeutic strategy in question and ultimately provide for a greater signal to noise ratio when looking at differences between patients as the noise of other cell types will not be present. Further, the blood sample may include the serum and even the RBCs which may be used in proteomic and other analysis using various cytokine protein microarrays and mass spectrometry methodologies.

In its most likely first embodiment the gene expression or proteomic assay will enable a physician to determine whether or not a patient is likely to be responsive to their cells for the clinical indication selected. The gene expression or proteomic patterns may indicate that (1) a simple autologous bone marrow mononuclear cell (ABM MNC) preparation, (2) a preparation of autologous bone marrow mesenchymal cells, (3) an unmodified adipose-derived stromal cell population, or (4) an adipose-derived autologous serum expansion of mesenchymal cells is best suited to treat the patient. This has not been performed previously. The gene expression or proteomic patterns can be detected with assays such as pre-existing assays whole genome microarrays provided by Agilent or Affymetrix and then identifying high fold change genes and using bio-informatic techniques to build classifiers which enables a smaller set of genes to be assayed using PCR or other high resolution measurement approach on a smaller set of genes (~20 or so). The methods for analyzing gene expression data included principal components analysis, linear discriminant analysis (LDA, StatSoft, Inc.), logistic regression (SAS Institute, Inc.), prediction analysis of microarrays (PAM) voting, classification and regression trees (TreeNet, Salford Systems), Random Forests, nearest shrunken centroids and k-nearest neighbors.

Once a small set of genes is selected confirming its potential remains nontrivial. Some groups (Deng et al American Journal of Transplantation 2006; 6: 150-160) have used these techniques to develop a linear discriminant analysis system which is relatively simple, other approaches are also possible which do not reduce the output to a simple scalar score. One approach involves ranking the genes for their ability to independently separate the groups and constructing a map that considers the independent score of each gene coupled with the relative score based on all more significant genes. Each gene creates three scenarios: A probability greater than 50+X % that patient is a responder, B probability greater than 50+X % that patient is a non-responder, or AB indeterminant in which neither A nor B is true. X may be selected and need not be that large for this technique to work well. The first gene then defines three classes: A1, B1, and AB1. The second gene builds on this scoring and one gets nine separate classifications possible: A1A2, A1B2, A1AB2, B1A2, B1B2, B1AB2, AB1A2, AB1B2, AB1AB2. A third gene similarly results in 81 independent states that may be assessed and so on. Such a graphical readout is possible for tens of genes which with color coding of the As and Bs one can begin to readily interpret patterns where there is high confidence on therapeutic effectiveness without discarding important data that may be useful for future analysis and interpreted graphically for up to 20 ranked genes (including quality control genes such as plant genes). If X is selected to be vanishingly small, a binary score is possible that makes tracking the decision aspects of each gene contributor to the algorithm much simpler.

As yet undefined algorithms may be employed in this invention as there is significant ongoing work in this area.

The tissue source for therapeutic cells can also be used for diagnostic purposes. In the preferred embodiment autologous bone marrow mononuclear cells (MNCs) are obtained in a small aspirate and sent to the laboratory to assess (1) potency of ABM as a therapeutic for a clinical indication, (2) the relative potency of the mesenchymal stromal cells that would be cultured from these cells, and (3) the ease and or likelihood that MSCs may be successfully cultured from the MNCs.

All autologous cell preparations may benefit from this strategy. Further these techniques may be applied to a wide host of clinical situations such as Graft Versus Host disease, Crohn's disease and other autoimmune diseases, periodontal repair, orthopaedic repair, and the like.

(4) Determining Susceptibility to Treatment

The following describes a method to determine, roughly, the susceptibility of patient populations to the autologous cell therapy. This description could address many different diseases such as heart failure, acute myocardial infarction, chronic ischemia, cardiovascular disease, peripheral vascular disease, or other cardiovascular disease as well as Crohn's disease and other autoimmune diseases, periodontal repair, and orthopaedic repair. For clarity we shall focus on heart failure. To accomplish this, small populations of patients suffering from heart failure are tested both for a wide array of gene expressions and for response to cell therapy. These small populations of patients are tested for a large number of gene expression signatures, markers etc., which may be detected with whole genome assays and interrogating numerous variables in the genome analysis. These patients are also treated with suitably promising autologous cell therapies, such as ACMEAMs (autologous serum expanded autologous mesenchymal cells), where the cells are injected into diseased cardiac tissue of the patient. After this therapeutic injection, patients are tested for typical indications of cardiac health, such as cardiac output, ejection fraction, ventricular wall motion, exercise tolerance, quality of life and the like (including many advanced invasive and non-invasive measurements).

Patients are then divided into groups, essentially those that are responsive to the treatment and those that are not. Each group is tested with a whole genome assay, which is interrogated under many variables in genomic analysis. The genomic assays of the two groups are compared, to ascertain differences in gene expressions that are consistent between the two groups. From the comparison of the gene expressions fold changes found in the responsive population to those found in the non-responsive population, candidate genes which are expressing differentially between the two groups. The goal is to develop a set of up to 20 genes that may be measured from the same autologous tissue (preferably from the source material of the therapeutic cells) indicative of a responder, but to identify a pattern of gene expressions that are indicative of a responder. Numerous genes may express identically in both populations, but several genes will express differentially. Those genes may be ignored, and need not be assayed, so that the assay consists of test for those genes which express differentially between responding and non-responding groups. Thus, the gene expression/proteomic signature profile to determine responders, or to determine non-responders, is developed with a small group of patients. Such an assay is best validated on a second independent population in a subsequent clinical trial.

Genes of particular interest might include genes listed SEQ ID NO: 1 through SEQ ID NO: 8832 of U.S. Pub. 20070037144 incorporated herein by reference.

After determining the group of gene expressions that indicate responsiveness (or that indicate non-responsiveness) to a particular cell therapy for a particular cardiac or cardiovascular condition, assays may be manufactured using RT-PCR or other similar technologies to detect the gene expressions indicative of responsiveness, or non-responsiveness, to one or more potential cell therapies. Prospective patients are then tested with the assays to determine if they are likely to be responsive, or non-responsive, to a particular cell therapy. This is accomplished by testing the cells obtained from the patient, subjecting the cells to the assay, and determining from the assay if the patient is likely to be a responder or a non-responder. It is likely that in some cases, no information will be available from the assay to inform the effectiveness of therapy.

For those identified as probably non-responsive, cell therapy may be avoided as a likely ineffective treatment, or initiated with a clear understanding that it is unlikely to be effective. This would save significant expense. For those identified as likely responders, the therapy may be accomplished by drawing blood in several blood draws, separating the serum from the blood to provide an autologous culture medium for that particular patient, aspirating a volume of bone marrow from the patient, and expanding mesenchymal stem cells derived from the bone marrow in autologous culture medium.

The cell therapy may be targeted on the basis of a single gene expression if it is clear that the single gene expression is an effective indicator of a patient's likely responsiveness to the autologous cell therapy. In this case, the method may be implemented by providing a diagnostic kit to determine whether a patient will respond to an autologous cell therapy for treatment of cardiovascular disease which includes a system for detecting gene expression comprising a single isolated DNA molecule which detects expression of a gene, a sample of autologous tissue the bone marrow, blood, or adipose tissue of the patient from which the putative therapeutic is derived and whose gene expression levels are to be measured. Cell therapy may be targeted on the basis of many variable gene expressions, without determination of a single controlling gene expression, by providing a prognostic kit to determine whether a patient will respond to an autologous cell therapy for treatment of cardiovascular disease, which includes a system for detecting gene expression comprising at least two, and perhaps dozens of isolated DNA molecules wherein each isolated DNA molecule detects expression of a gene. In each instance, the gene expression detected by the assay is analyzed and compared to the expression of control groups to determine the susceptibility of the particular patient to the cell therapy. One simple example may be identification of risk factors related to poor angiogenic potency by assessing the cells upon aspiration.

By developing a diagnostic step that involves information on the therapeutic being delivered in the therapeutic process, additional information on the therapy, its responders, and its non-responders will be developed over time. Although the initial value is binary decision of whether a patient will respond or not because of (i) their genetic makeup and (ii) the characteristics of the therapeutic autologous cells will have power over time other details may also emerge regarding best dosage, best subpopulations of cells, whether or not one or more strategies to enhance a particular genes expression levels would improve therapy and the like.

The two value propositions to autologous cell therapies such as those described here is that they are safe and that they contain information specific to the therapeutic and the patient. These value propositions are believed to be enhanced the closer to truly autologous a putative therapeutic strategy is.

While the preferred embodiments of the devices, diagnostic kits, and methods have been described in reference to the environment in which they were developed, they are merely illustrative of the principles of the inventions. For example, the gene expression signature for a disease such as heart failure could be developed based on surrogate in vitro and in vivo animal assays for potency and subsequently validated and refined in clinical study. Systemic correlation of in vitro and small animal in vivo surrogate potency assays of MCS to gene expression profiles of the harvested source tissue as well as cultured cells from this tissue can be performed. Potential mechanisms of action of MSCs could be assessed through four potency assays. The anti-apoptotic potential of the cells will be assayed by co-culture with rat myocytes, Hoescht staining of the later and expression of Bcl2/Bax by western blotting. Growth factors secretion, by RT-PCR on SDF-1, HGF, IGF and VEGF will be measured as they are seen as responsible for the pro-angiogenic potential of the MSCs. Cells will also be differentiated in cardiomyocytes using 5 azacytidine as transdifferentiation has also been described as a putative mechanism of action. Further surrogate identifiers of potency for preclinical development of a gene signature includes: the colony-forming capacity of BM-MNCs, response of cells to stromal cell-derived factor 1 (SDF-1), response to vascular endothelial growth factor (VEGF), and in vivo neovascularization capacity as measured by laser Doppler-derived relative limb blood flow in mice treated with BM-MNCs.

Other embodiments and configurations may be devised without departing from the spirit of the inventions and the scope of the appended claims.

SEQUENCE LISTING (8832 sequences)

SEQ ID NO: 1 - DNA, 50 bp, Homo sapiens
agagcacttgcagagcctgggacaacctccttattgaagggaagagggac

SEQ ID NO: 2 - DNA, 50 bp, Homo sapiens
tggtctcaaagatttacatggcaacattcgaaagtccccagagaagtcct

SEQ ID NO: 3 - DNA, 50 bp, Homo sapiens
aggacttctctggggactttcgaatgttgccatgtaaatctttgagacca

SEQ ID NO: 4 - DNA, 50 bp, Homo sapiens
aggtgccagcaactgaataaatacctctcccagtgtaaatctggagccaa

SEQ ID NO: 5 - DNA, 50 bp, Homo sapiens
gggtgtctttaaatagcactagccaaatcacatatctccaacactcctta

SEQ ID NO: 6 - DNA, 50 bp, Homo sapiens
taaggagtgttggagatatgtgatttggctagtgctatttaaagacaccc

SEQ ID NO: 7 - DNA, 50 bp, Homo sapiens
cccacagtgcaattcagaatatgctcagggaatgccagccaccttgtaaa

SEQ ID NO: 8 - DNA, 50 bp, Homo sapiens
gccaagacaataagctaggctactgggtccagctactactttggtgggat

SEQ ID NO: 9 - DNA, 50 bp, Homo sapiens
atcccaccaaagtagtagctggacccagtagcctagcttattgtcttggc

SEQ ID NO: 10 - DNA, 50 bp, Homo sapiens
aatttataactcctaggggttatttctgtgccagacacattccacctctc

SEQ ID NO: 11 - DNA, 50 bp, Homo sapiens
actaattgcattggcagcattgtgtctttgaccttgtatactagcttgac

SEQ ID NO: 12 - DNA, 50 bp, Homo sapiens
aaaccaaaaataatcacaacagaaaccagctgccccaaaggaaccagagg

SEQ ID NO: 13 - DNA, 50 bp, Homo sapiens
tcccaccaggactttgctaacaataatgtttggaaataaagaagtgctct

SEQ ID NO: 14 - DNA, 50 bp, Homo sapiens
tgacactcatgccaacaagaacctgtgcccctccttcctaacctgaggcc

SEQ ID NO: 15 - DNA, 50 bp, Homo sapiens
acaaattttaccctaacagttttaccacctagcaacagtcatttctgaaa

SEQ ID NO: 16 - DNA, 50 bp, Homo sapiens
tttattggtacttcctaaagatagagactaaagtcatggtagtattggcc

SEQ ID NO: 17 - DNA, 50 bp, Homo sapiens
ggccaatactaccatgactttagtctctatctttaggaagtaccaataaa

SEQ ID NO: 18 - DNA, 50 bp, Homo sapiens
cctcccattttgttctcggaagattaaatgctacatgtgtaagtctgcct

SEQ ID NO: 19 - DNA, 50 bp, Homo sapiens
ccgtgcccggaaacaggccgtggctagagaagagcgagatcatctttacc

SEQ ID NO: 20 - DNA, 50 bp, Homo sapiens
ggtctaatttattcaaagggggcaagaagtagcagtgtctgtaaaagagc

SEQ ID NO: 21 - DNA, 50 bp, Homo sapiens
agatgggtgaatcagttgggttttgtaaatacttgtatgtggggaagaca

SEQ ID NO: 22 - DNA, 50 bp, Homo sapiens
tctctagttgtcactttcctcttccactttgataccattgggtcattgaa

SEQ ID NO: 23 - DNA, 50 bp, Homo sapiens
tcaaaagaaagccttctggatgctgttaagatgtacccttcaggtgaacc

SEQ ID NO: 24 - DNA, 50 bp, Homo sapiens
ccccctttccttctaatttttcagctccttcaatgcaaagtacatgtatt

SEQ ID NO: 25 - DNA, 50 bp, Homo sapiens
cctccaaccccggaaacttcctgtgcaacccagactatcacctttgaaag

SEQ ID NO: 26 - DNA, 50 bp, Homo sapiens
ggaaggtagtcttcatttgcaatcaggaaaacgaacgtaaaggcacaggt

SEQ ID NO: 27 - DNA, 50 bp, Homo sapiens
acctgtgcctttacgttcgttttcctgattgcaaatgaagactaccttcc

SEQ ID NO: 28 - DNA, 50 bp, Homo sapiens
tgttttcctcactacattgtacatgtgggaattacagataaacggaagcc

SEQ ID NO: 29 - DNA, 50 bp, Homo sapiens
cagagcaagaccctgaagacccccaaccacggcctaaaagcctctttgtg

SEQ ID NO: 30 - DNA, 50 bp, Homo sapiens
gcttcatatgtatggctgttgctttgcttcatgtgtatggctatttgtat

SEQ ID NO: 31 - DNA, 50 bp, Homo sapiens
cagatgggttcagcagtctggtcagtgagaaagggccgagggtagacagg

SEQ ID NO: 32 - DNA, 50 bp, Homo sapiens
tccagggcaatcaatgttcacgcaacttgaaattatatctgtggtcttca

SEQ ID NO: 33 - DNA, 50 bp, Homo sapiens
tcatcccgagaacattggcttccacatcacagtatctacccttacatggt

SEQ ID NO: 34 - DNA, 50 bp, Homo sapiens
cgctctcgatattcctgtgcagaaacctggaccacgtctacaaccggctc

SEQ ID NO: 35 - DNA, 50 bp, Homo sapiens
cctgctcagctctgcataagtaattcaagaaatgggaggcttcaccttaa

SEQ ID NO: 36 - DNA, 50 bp, Homo sapiens
ggaggacccacactgctacacttctgatcccctttggttttactacccaa

SEQ ID NO: 37 - DNA, 50 bp, Homo sapiens
gaagaacagcagatggcggtgatcagcagagagattgaactttgaggagg

SEQ ID NO: 38 - DNA, 50 bp, Homo sapiens
ggaatttcctatcttgcagcatcctgtaaataaacattcaagtccaccct

SEQ ID NO: 39 - DNA, 50 bp, Homo sapiens
cctcaaagtgctaccgataaacctttctaattgtaagtgcccttactaag

SEQ ID NO: 40 - DNA, 50 bp, Homo sapiens
agtgggtcccagattggctcacactgagaatgtaagaactacaaacaaaa

SEQ ID NO: 41 - DNA, 50 bp, Homo sapiens
ctgtccagcgccaacagcctctatgacgacatcgagtgcttccttatgga

SEQ ID NO: 42 - DNA, 50 bp, Homo sapiens
aaattctggtaagtatgtgcttttctgtgggggtgggatttggaaggggg

SEQ ID NO: 43 - DNA, 50 bp, Homo sapiens
atgggtgaagagaaccgagcaaagatcaaaataaaaagtgacacagcagc

SEQ ID NO: 44 - DNA, 50 bp, Homo sapiens
gctgtgtccatctttgtcactgagtgaaatctctgttttctattctctga

SEQ ID NO: 45 - DNA, 50 bp, Homo sapiens
atgtgctgtcaaaacaagtttttctgtcaagaagatgatcagaccttgga

SEQ ID NO: 46 - DNA, 50 bp, Homo sapiens
cagtgatcagggtcctgcaagcagtggggaagggggccaaggtattggag

SEQ ID NO: 47 - DNA, 50 bp, Homo sapiens
tggacacacggatcaagaccaggaagaattgaacttgtcaaggtgaaggg

SEQ ID NO: 48 - DNA, 50 bp, Homo sapiens
aacagaccccctctagaaatttttcagatgcttctgggagacaccaaagg

SEQ ID NO: 49 - DNA, 50 bp, Homo sapiens
gtcagtaggtgcggtgtctagggtagtgaatcctgtaagttcaaatttat

SEQ ID NO: 50 - DNA, 60 bp, Homo sapiens
agttgtgtggtcagtaggtgcggtgtctagggtagtgaatcctgtaagttcaaatttatg

SEQ ID NO: 51 - DNA, 70 bp, Homo sapiens
tttaagttgtgtggtcagtaggtgcggtgtctagggtagtgaatcctgtaagttcaaatttatgattagg

SEQ ID NO: 52 - DNA, 50 bp, Homo sapiens
gtttgagatggacacactggtgtggattaacctgccagggagacagagct

SEQ ID NO: 53 - DNA, 50 bp, Homo sapiens
ttgtgactctgaatcccatgttctcaaactacgctgccttccgaagtctg

SEQ ID NO: 54 - DNA, 50 bp, Homo sapiens
tttaagtactaagtcatcatttgccttgaaagtttcctctgcattgggtt

SEQ ID NO: 55 - DNA, 50 bp, Homo sapiens
aacccaatgcagaggaaactttcaaggcaaatgatgacttagtacttaaa

SEQ ID NO: 56 - DNA, 50 bp, Homo sapiens
tacctgggcattcttgtttcattcaattccacctgcaatcaagtcctaca

SEQ ID NO: 57 - DNA, 60 bp, Homo sapiens
ccattaaacttacctgggcattcttgtttcattcaattccacctgcaatcaagtcctaca

SEQ ID NO: 58 - DNA, 70 bp, Homo sapiens
cacctgcaatcaagtcctacaagctaaaattagatgaactcaactttgacaaccatgagaccactgttat

SEQ ID NO: 59 - DNA, 50 bp, Homo sapiens
aatgcgtacgtttcctgagaagtgtctaaaaacaccaaaaagggatccgt

SEQ ID NO: 60 - DNA, 60 bp, Homo sapiens
acgtttcctgagaagtgtctaaaaacaccaaaaagggatccgtacattcaatgtttatgc

SEQ ID NO: 61 - DNA, 70 bp, Homo sapiens
caaatcaatgcgtacgtttcctgagaagtgtctaaaaacaccaaaaagggatccgtacattcaatgttta

SEQ ID NO: 62 - DNA, 50 bp, Homo sapiens
ctccgggagaggggacggtcaatcctgtgggtgaagacagagggaaacac

SEQ ID NO: 63 - DNA, 50 bp, Homo sapiens
ggctgggaaactgttggtggccagtgggtaataaagacctttcagtatcc

SEQ ID NO: 64 - DNA, 50 bp, Homo sapiens
tgctagaggggcttagagaactacaaggcctgcagaatttcccagagaag

SEQ ID NO: 65 - DNA, 50 bp, Homo sapiens
ctgactcaggatgacagacaggtggaactgccagtgtagagggaattcta

SEQ ID NO: 66 - DNA, 50 bp, Homo sapiens
gtaaaggctatacttgtcttgttcaccttgggatgacgccgcatgatatg

SEQ ID NO: 67 - DNA, 50 bp, Homo sapiens
caagcaggaagcacaaactcccccaagctgactcatcctaactaacagtc

SEQ ID NO: 68 - DNA, 50 bp, Homo sapiens
tcttcaacagaccccctctagaaatttttcagatgcttctgggagacacc

SEQ ID NO: 69 - DNA, 50 bp, Homo sapiens
gtcctccacgccatttccttttccttcaagcctagcccttctctcattat

SEQ ID NO: 70 - DNA, 50 bp, Homo sapiens
ggcccttcatgtacatccatggtgtgctggcttaaaatgtaattaatctt

SEQ ID NO: 71 - DNA, 50 bp, Homo sapiens
aagatgcccaaccctgtgatcagaacctccaaatactgccatgagaaact

SEQ ID NO: 72 - DNA, 50 bp, Homo sapiens
caggagtttgtgtgtcttttataaaaagtttgccctggatgtcatattgg

SEQ ID NO: 73 - DNA, 50 bp, Homo sapiens
ccctgagtgacagtcacgacagaacaaaaccacaagaccagaccacattt

SEQ ID NO: 74 - DNA, 50 bp, Homo sapiens
cctttacatccagataggttaccagtaacggaacatatccagtactcctg

SEQ ID NO: 75 - DNA, 50 bp, Homo sapiens
tgcatcgtaaaaccttcagaaggaaaggagaatgttttgtggaccacttt

SEQ ID NO: 76 - DNA, 50 bp, Homo sapiens
ggccactgaatgggtaggagcaaccactgactggtcttaagctgttcttg

SEQ ID NO: 77 - DNA, 50 bp, Homo sapiens
tgtagggtaaatgtgactggaatacacctttggaacggaattctttatca

SEQ ID NO: 78 - DNA, 50 bp, Homo sapiens
aggctggacatcggcccgctccccacaatgaaataaagttattttctcat

SEQ ID NO: 79 - DNA, 50 bp, Homo sapiens; identical to SEQ ID NO: 77

SEQ ID NO: 80 - DNA, 50 bp, Homo sapiens
gttgccatggtgatggtgtagccctcccactttgctgttccttactttac

SEQ ID NO: 81 - DNA, 50 bp, Homo sapiens
ccacccacccctcaattaaggcaacaatgaagttaatggataccctctgc

SEQ ID NO: 82 - DNA, 50 bp, Homo sapiens; identical to SEQ ID NO: 80

SEQ ID NO: 83 - DNA, 50 bp, Homo sapiens; identical to SEQ ID NO: 81

SEQ ID NO: 84 - DNA, 50 bp, Homo sapiens
gctcacctatttgggttaagcatgccaatttaaagagaccaagtgtatgt

SEQ ID NO: 85 - DNA, 50 bp, Homo sapiens
tccaccttttgtatttaattttaaagtcagtgtactgcaaggaagctgga

SEQ ID NO: 86 - DNA, 50 bp, Homo sapiens
ccctatcccgcaaaatgggcttcctgcctgggtttttctcttctcacatt

SEQ ID NO: 87 - DNA, 50 bp, Homo sapiens; identical to SEQ ID NO: 85

SEQ ID NO: 88 - DNA, 50 bp, Homo sapiens
agatcttcaagtgaacatctcttgccatcacctagctgcctgcacctgcc

SEQ ID NO: 89 - DNA, 50 bp, Homo sapiens
gctaattttaagcatgttcagtggcagctcccctccagtttcagtgtcac

SEQ ID NO: 90 - DNA, 50 bp, Homo sapiens
cctgtgatcaggctcccaagtctggttcccatgaggtgagatgcaacctg

SEQ ID NO: 91 - DNA, 50 bp, Homo sapiens
acatggtttgactcccgaacatcaccgacgtgtctcctgtttttctgggt

SEQ ID NO: 92 - DNA, 50 bp, Homo sapiens
tcagagctgaagaagcgagctggatggcaaggcctgtgcgacagataatg

SEQ ID NO: 93 - DNA, 50 bp, Homo sapiens
tcagccattttgggcatatgtatctttataatcagactggaaacgggact

SEQ ID NO: 94 - DNA, 50 bp, Homo sapiens
atcctggcaaccttacaattcctctcggcatttgtcacttccatctcagc

SEQ ID NO: 95 - DNA, 50 bp, Homo sapiens
agcttactacagtgaaagaatgggattggcaagtaacttctgacttactg

SEQ ID NO: 96 - DNA, 50 bp, Homo sapiens
attataacatcttcaacacagaacacactttgtggtcgaaaggctcagcc

SEQ ID NO: 97 - DNA, 50 bp, Homo sapiens
tgtcagagattgcctgtggctctaatatgcacctcaagattttaaggaga

SEQ ID NO: 98 - DNA, 50 bp, Homo sapiens
tgtctggcagggactgaatgacctgatgtcagatttagattcttcctggg

SEQ ID NO: 99 - DNA, 50 bp, Homo sapiens
gggaggaacactgcactcttaagcttccgccgtctcaacccctcacagga

SEQ ID NO: 100 - DNA, 50 bp, Homo sapiens
atgaagaagggtgtgaaggctgaacaatcatggatttttctgatcaattg

SEQ ID NO: 101 - DNA, 50 bp, Homo sapiens
gcctctgctccccagggagttgtgtctgtaatcggcctactattcagtgg

SEQ ID NO: 102 - DNA, 50 bp, Homo sapiens
ggatgctactgatgggaatgattaagggagctgctgtttaggtggtgctg

SEQ ID NO: 103 - DNA, 50 bp, Homo sapiens
tcaggaacaacatctactgcatggcccagctgctggacaactcagacacg

SEQ ID NO: 104 - DNA, 50 bp, Homo sapiens
cttacatcaggtactttgtcagcttcatcatccagttccagttccacgag

SEQ ID NO: 105 - DNA, 50 bp, Homo sapiens
catccaggagctgttcaagcgcatctccgagcagttcacggccatgttcc

SEQ ID NO: 106 - DNA, 50 bp, Homo sapiens
acctcccactttgtctgtacatactggcctctgtgattacatagatcagc

SEQ ID NO: 107 - DNA, 50 bp, Homo sapiens
gtctttgagaatatgatgtcagacattttcggatgggctgtttagatgtt

SEQ ID NO: 108 - DNA, 50 bp, Homo sapiens
ggtcacccaggaggatggcaaagagagtcgcatctcagtgcaggagagac

SEQ ID NO: 109 - DNA, 50 bp, Homo sapiens
agacccttatctggaggaggaagagaagcaggagagagaaagccacagcc

SEQ ID NO: 110 - DNA, 50 bp, Homo sapiens
ggctgtgtcctaaggcccatttgagaagctgaggctagttccaaaaacct

SEQ ID NO: 111 - DNA, 50 bp, Homo sapiens
gtgctcctgtaagtcaaatgtgtgctttgtactgctgttgttgaaattga

SEQ ID NO: 112 - DNA, 50 bp, Homo sapiens
cagagacataaagagaagatgccaaggccccctcctccacccaccgctaa

SEQ ID NO: 113 - DNA, 50 bp, Homo sapiens
atgggagtaataagagcagtggcagcagcatctctgaacatttctctgga

SEQ ID NO: 114 - DNA, 50 bp, Homo sapiens
ccactaatcctgatgaggctgacaaagttggggctgagaacacaatcacc

SEQ ID NO: 115 - DNA, 50 bp, Homo sapiens
tgttggggtttcctttaccttttctataagttgtaccaaaacatccactt

SEQ ID NO: 116 - DNA, 50 bp, Homo sapiens
cagagtaggcatctgggcaccaagaccttccctcaacagaggacactgag

SEQ ID NO: 117 - DNA, 50 bp, Homo sapiens
ctttgcctaaaccctatggcctcctgtgcatctgtactcaccctgtacca

SEQ ID NO: 118 - DNA, 50 bp, Homo sapiens; identical to SEQ ID NO: 76

SEQ ID NO: 119 - DNA, 50 bp, Homo sapiens
tgattctgcacttggggtctgtctgtacagttactcatgtcattgtaatg

SEQ ID NO: 120 - DNA, 50 bp, Homo sapiens
tgtgtaataggccttttcatgctttatgtgtagctttttacctgtaacct

SEQ ID NO: 121 - DNA, 50 bp, Homo sapiens
aagttatcatgtccatccgcaccaagctgcagaacaaggagcatgtgatt

SEQ ID NO: 122 - DNA, 50 bp, Homo sapiens; identical to SEQ ID NO: 121

SEQ ID NO: 123 - DNA, 50 bp, Homo sapiens
tggtggatgttaaaccaatattcctttcaactgctgcctgctagggaaaa

SEQ ID NO: 124 - DNA, 50 bp, Homo sapiens
tgaacttgctgaatgtaaggcaggctactatgcgttataatctaatcaca

SEQ ID NO: 125 - DNA, 50 bp, Homo sapiens
atttgaccagagcaaagctgaaaaatgaataactaaccccctttccctgc

SEQ ID NO: 126 - DNA, 60 bp, Homo sapiens
gcaattggagaactggatttgctgtttatgtctctgagaaatgcctgcatttgaccagag

SEQ ID NO: 127 - DNA, 70 bp, Homo sapiens
tttgaccagagcaaagctgaaaaatgaataactaaccccctttccctgctagaaataacaattagatgcc

SEQ ID NO: 128 - DNA, 50 bp, Homo sapiens
ccctttttgtcccccaacttgagatgtatgaaggcttttggtctccctgg

SEQ ID NO: 129 - DNA, 50 bp, Homo sapiens
attagaccagaccagtgtatttctaaagaaaatcctgacatgcacaccca

SEQ ID NO: 130 - DNA, 50 bp, Homo sapiens
gaccctactgctgatgataccagtgctgctgtaactgaagaaatgccacc

SEQ ID NO: 131 - DNA, 50 bp, Homo sapiens
acaggcaaagtgacaggggaaaaggaattagtctaagagtaaggggatga

SEQ ID NO: 132 - DNA, 50 bp, Homo sapiens
ctttcctcttgctgctggggcctaggtcttcttgctgctgcttccttttc

SEQ ID NO: 133 - DNA, 50 bp, Homo sapiens
agagtttttgttggtagactggagctgggatgttgaatcaacctcaggca

SEQ ID NO: 134 - DNA, 50 bp, Homo sapiens
tgcctgaggttgattcaacatcccagctccagtctaccaacaaaaactct

SEQ ID NO: 135 - DNA, 50 bp, Homo sapiens
ctgacgatcagcttggaacagccaaacagaattaacgcaactaataacct

SEQ ID NO: 136 - DNA, 50 bp, Homo sapiens
tccttttatgcattggaggaaaaacatgttggcttttctcttgacgtggg

SEQ ID NO: 137 - DNA, 50 bp, Homo sapiens
cccacgtcaagagaaaagccaacatgtttttcctccaatgcataaaagga

SEQ ID NO: 138 - DNA, 50 bp, Homo sapiens
ctcaggaaacccgacagaagaaacatgtaacacagaactcacgtccacta

SEQ ID NO: 139 - DNA, 50 bp, Homo sapiens
actcgagacgtaaattatggctgaatcatccgctaccttcacgccaatgg

SEQ ID NO: 140 - DNA, 50 bp, Homo sapiens
tgctgttttcattctgcatttgtgtagtttggtgctttgttccaagttaa

SEQ ID NO: 141 - DNA, 50 bp, Homo sapiens
aaaaatgacaaaagttatcaccaaaaccccctttcccatcttgcactgtt

SEQ ID NO: 142 - DNA, 50 bp, Homo sapiens
agcttttaatgctccaaatgctgacccatgcaatatttcctcatgtgatc

SEQ ID NO: 143 - DNA, 50 bp, Homo sapiens
aaaagaaatgcaggtttattatccagcactgagagagttaacaaggactg

SEQ ID NO: 144 - DNA, 50 bp, Homo sapiens
agagagacttctcattggctgtgaaggtagagcttttggggaaattcctg

SEQ ID NO: 145 - DNA, 50 bp, Homo sapiens
caggaatttccccaaaagctctaccttcacagccaatgagaagtctctct

SEQ ID NO: 146 - DNA, 50 bp, Homo sapiens; identical to SEQ ID NO: 144

SEQ ID NO: 147 - DNA, 50 bp, Homo sapiens
catctcagccctgcctttctctggagcattctgaaaacagatattctggc

SEQ ID NO: 148 - DNA, 50 bp, Homo sapiens
tcatgataacctgcagacctgatcaagcctctgtgcctcagtttctctct

SEQ ID NO: 149 - DNA, 50 bp, Homo sapiens
atgggggtaataagagcagtagcagcagcatctctgaacatttctctgga

SEQ ID NO: 150 - DNA, 50 bp, Homo sapiens
gaaattgcttttcctcttgaaccacagttctacccctgggatgttttgag

SEQ ID NO: 151 - DNA, 50 bp, Homo sapiens
aattcctcaggaagtaaaaccgaagaagatggcccagctccccaagaaag

SEQ ID NO: 152 - DNA, 50 bp, Homo sapiens
aacatccaaggagaaacagagacaggcccaagagatgaagagtgagaggg

SEQ ID NO: 153 - DNA, 50 bp, Homo sapiens
tcgtgtgaatcagactaagtgggatttcatttttacaactctgctctact

SEQ ID NO: 154 - DNA, 50 bp, Homo sapiens
gcatatacaagttggaagactaaagaggtgcaatgtgatctgagcctcca

SEQ ID NO: 155 - DNA, 50 bp, Homo sapiens
tgagtgtgtttgtgtgcatgaaagagaaagactgattacctcctgtgtgg

SEQ ID NO: 156 - DNA, 50 bp, Homo sapiens
agctgttcccaaattttctaacgagtggaccattatcactttaaagccct

SEQ ID NO: 157 - DNA, 50 bp, Homo sapiens
atcaacagaccaacatttttctcttcctcaagcaacactcctagggcctg

SEQ ID NO: 158 - DNA, 50 bp, Homo sapiens
tatgactgatgatcctccaacaacaaaaccacttactgctcgtaaattca

SEQ ID NO: 159 - DNA, 50 bp, Homo sapiens
aaaatactgatgttcctagtgaaagaggcagcttgaaactgagatgtgaa

SEQ ID NO: 160 - DNA, 50 bp, Homo sapiens
ggaagactttaaaccacctagttctcccactggggcatcggtctaaagct

SEQ ID NO: 161 - DNA, 50 bp, Homo sapiens
ccctgttccacaaacccatatgtatcctttcctcaacctcctcctttccc

SEQ ID NO: 162 - DNA, 50 bp, Homo sapiens
gtgtgtgagtgtgagtgtgagcgagagggtgagtgtggtcagagtaaagc

SEQ ID NO: 163 - DNA, 50 bp, Homo sapiens
tctggtcattcaaggatcccctcccaaggctatgcttttctataactttt

SEQ ID NO: 164 - DNA, 50 bp, Homo sapiens
ggcagctcaggaccactccaatgacccacctaacaagatgaatgaagtta

SEQ ID NO: 165 - DNA, 50 bp, Homo sapiens
tgttcttcatctaagccttctggttttatgggtcagagttccgactgcca

SEQ ID NO: 166 - DNA, 50 bp, Homo sapiens
gccttcatgcacctgtcctttctaacacgtcgccttcaactgtaatcaca

SEQ ID NO: 167 - DNA, 50 bp, Homo sapiens
ccctctcctctcttcctccctggaatcttgtaaaggtcctggcaaagatg

SEQ ID NO: 168 - DNA, 50 bp, Homo sapiens
ctgggctgggacgtgacctgtgctgagggctgtgagaatgtgaaacaaca

SEQ ID NO: 169 - DNA, 50 bp, Homo sapiens
gggatgaacgaaagccccctcttcaactcctctcactttttaaagcattg

SEQ ID NO: 170 - DNA, 50 bp, Homo sapiens
acaatgttgagttcagcatgtgtctgccatttcatttgtacgcttgttca

SEQ ID NO: 171 - DNA, 50 bp, Homo sapiens
tttcagtcccagaacctacagataccctgctacttgcttcacgtggatgc

SEQ ID NO: 172 - DNA, 50 bp, Homo sapiens
aattcagttagctccattcagaaccaaatgcagtccaagggaggttatgg

SEQ ID NO: 173 - DNA, 50 bp, Homo sapiens
cccatcttacagaagttgaggccaagggagaatggtaggcacagaagaaa

SEQ ID NO: 174 - DNA, 50 bp, Homo sapiens
tgtgttaagtgcaggagacattggtattctgggcaccttcctaatatgct

SEQ ID NO: 175 - DNA, 50 bp, Homo sapiens
tgtgttaagtgcaggagacattggtattctgggcagcttcctaatatgct

SEQ ID NO: 176 - DNA, 50 bp, Homo sapiens
agctgtgttggtagtgctgtgttgaattacggaataatgagttagaacta

SEQ ID NO: 177 - DNA, 50 bp, Homo sapiens; identical to SEQ ID NO: 115

SEQ ID NO: 178 - DNA, 60 bp, Homo sapiens
tgcatgttggggtttcctttaccttttctataagttgtaccaaaacatccacttaagttc

SEQ ID NO: 179 - DNA, 70 bp, Homo sapiens
tgttggggtttcctttaccttttctataagttgtaccaaaacatccacttaagttctttgatttgtacca

SEQ ID NO: 180 - DNA, 50 bp, Homo sapiens
tctacctgcagtctccattgtttccagagtgaacttgtaattatcttgtt

SEQ ID NO: 181 - DNA, 50 bp, Homo sapiens
gtgtgcgtgtgtgtgtgcctgtccagtgtatattgtgtcttagcttccat

SEQ ID NO: 182 - DNA, 50 bp, Homo sapiens
ctgaagggaagagagccttgaatagactgaagcgaagacggttctgcaag

SEQ ID NO: 183 - DNA, 50 bp, Homo sapiens
ttctctgcatctaggccatcatactgccaggctggttatgactcagaaga

SEQ ID NO: 184 - DNA, 50 bp, Homo sapiens
cttcctgtacctcctccccacagcttgcttttgttgtaccgtctttcaat

SEQ ID NO: 185 - DNA, 50 bp, Homo sapiens
aacctgcacaagcatgtaataaaagagcacacttaaaaacattctgacca

SEQ ID NO: 186 - DNA, 50 bp, Homo sapiens
tggtcagaatgtttttaagtgtgctcttttattacatgcttgtgcaggtt

SEQ ID NO: 187 - DNA, 50 bp, Homo sapiens
ccttctgaaggtgtatagatacagcttgtcttgaaatgtctttctccaca

SEQ ID NO: 188 - DNA, 50 bp, Homo sapiens
tgtggagaaagacatttcaagacaagctgtatctatacaccttcagaagg

SEQ ID NO: 189 - DNA, 50 bp, Homo sapiens
tgctaggtcacagaggatctgcttggtcttgataagctatgttgttgcac

SEQ ID NO: 190 - DNA, 50 bp, Homo sapiens
ctagaggaccattcatgcaatgactatttctaaagcacctgctacacagc

SEQ ID NO: 191 - DNA, 50 bp, Homo sapiens
gggagtttctgagggtctgctttgtttacctttcgtgcggtggattcttt

SEQ ID NO: 192 - DNA, 50 bp, Homo sapiens
tcggaggagtcggacgaggatatgggatttggtctctttgactaatcacc

SEQ ID NO: 193 - DNA, 50 bp, Homo sapiens
ttccttcctcggtggtgttaatcatttcgtttttaccctttaccttcgga

SEQ ID NO: 194 - DNA, 50 bp, Homo sapiens
gtctacatcaactattacgacatgaacgcggccaatgtgggctggaacaa

SEQ ID NO: 195 - DNA, 50 bp, Homo sapiens
cagaagggtcaaaaagctccagcccagaaagcacctgctccaaaggcatc

SEQ ID NO: 196 - DNA, 50 bp, Homo sapiens
gaccttcctgccaccagtcactgtccctcaaatgacccaaagaccaatat

SEQ ID NO: 197 - DNA, 50 bp, Homo sapiens
gagatggggagggctaccacagagttatccactttacaacggagacacag

SEQ ID NO: 198 - DNA, 50 bp, Homo sapiens
atgggtttggcttgaggctggtagcttctatgtaattcgcaatgattcca

SEQ ID NO: 199 - DNA, 50 bp, Homo sapiens
catccctccatgtactctgggtatcagcaactgtcctcatcagtctccat

SEQ ID NO: 200 - DNA, 50 bp, Homo sapiens
accttacaggagatcatcaaaactttgaacagcctcacagagcagaagac

SEQ ID NO: 201 - DNA, 50 bp, Homo sapiens
gagaagacagtggcgaccaagacgattttctgccttagagcaagggattc

SEQ ID NO: 202 - DNA, 50 bp, Homo sapiens
caggggatcagtgaaggaagagaaggccagcagatcagtgagagtgcaac

SEQ ID NO: 203 - DNA, 50 bp, Homo sapiens
cccattccctctctactcttgacagcaggattggatgttgtgtattgtgg

SEQ ID NO: 204 - DNA, 50 bp, Homo sapiens
acttaatatgtgggaaacccttttgcgtggtccttaggcttacaatgtgc

SEQ ID NO: 205 - DNA, 50 bp, Homo sapiens
aaaatacaagggctgttggtgagagcagacttgaggtgatgatagttggc

SEQ ID NO: 206 - DNA, 50 bp, Homo sapiens
ccagattttccccaaacttgcttctgttgagatttttccctcaccttgcc

SEQ ID NO: 207 - DNA, 50 bp, Homo sapiens
accttgggttgagtaatgctcgtctgtgtgttttagtttcatcacctgtt

SEQ ID NO: 208 - DNA, 50 bp, Homo sapiens
aaactcccctttcttgaggttgtctgagtcttgggtctatgccttgaaaa

SEQ ID NO: 209 - DNA, 50 bp, Homo sapiens
ctcagtgttggtgtggtgatgtttgttgcttttatgatttcatattgtgc

SEQ ID NO: 210 - DNA, 50 bp, Homo sapiens
ctgtatctttgacaattctgggtgcgagtgtgagagtgtgagcagggctt

SEQ ID NO: 211 - DNA, 50 bp, Homo sapiens
gataagtgtcctatggggatggtccactgtcactgtttctctgctgttgc

SEQ ID NO: 212 - DNA, 60 bp, Homo sapiens
tttagccaaaggataagtgtcctatggggatggtccactgtcactgtttctctgctgttg

SEQ ID NO: 213 - DNA, 70 bp, Homo sapiens
atttatattagtttagccaaaggataagtgtcctatggggatggtccactgtcactgtttctctgctgtt

SEQ ID NO: 214 - DNA, 50 bp, Homo sapiens
gaaggaagaagtggggtggaagaagtggggtgggacgacagtgaaatcta

SEQ ID NO: 215 - DNA, 50 bp, Homo sapiens
ccatcaatgaggtatcttctttagtggtggtatgtaatggaacttagcca

SEQ ID NO: 216 - DNA, 50 bp, Homo sapiens
aaagacgtgcactcaaccttctaccaggccactctcaggctcaccttaaa

SEQ ID NO: 217 - DNA, 50 bp, Homo sapiens
ccaagctgcttgtcctgggcctgcccctgtgtattcaccaccaataaatc

SEQ ID NO: 218 - DNA, 50 bp, Homo sapiens
cactggggacgagacaggtgctaaagttgaacgagctgatggatatgaac

SEQ ID NO: 219 - DNA, 50 bp, Homo sapiens
cgttgctgaagtggtaattgaggaaaacagttccccagattgttaagagt

SEQ ID NO: 220 - DNA, 50 bp, Homo sapiens
ctccccgtgagcactgcgtacaaacatccaaaagttcaacaacaccagaa

SEQ ID NO: 221 - DNA, 50 bp, Homo sapiens
agtgcctttcaggatctatttttggaggtttattacgtatgtctggttct

SEQ ID NO: 222 - DNA, 50 bp, Homo sapiens
agaacaaactaagccaggtatgcaaatatcgctgaatagaaacagatgga

SEQ ID NO: 223 - DNA, 50 bp, Homo sapiens; identical to SEQ ID NO: 222

SEQ ID NO: 224 - DNA, 50 bp, Homo sapiens
gcaattcctcaggctaagctgccggttcttaaatccatcctgctaagtta

SEQ ID NO: 225 - DNA, 50 bp, Homo sapiens
tcctggtggctctttgtggaggaaactaaacattcccttgatggtctcaa

SEQ ID NO: 226 - DNA, 50 bp, Homo sapiens
ctttgggttggagctgttccattgggtcctcttggtgtcgtttccctccc

SEQ ID NO: 227 - DNA, 50 bp, Homo sapiens
agaaaaagcttgggttaactcagtagttagatcaaagcaaatgtggactg

SEQ ID NO: 228 - DNA, 50 bp, Homo sapiens
acagatgtagcaacatgagaaacgcttatgttacaggttacatgagagca

SEQ ID NO: 229 - DNA, 50 bp, Homo sapiens
tgtttaatggtagttttacagtgtttctggcttagaacaaaggggcttaa

SEQ ID NO: 230 - DNA, 50 bp, Homo sapiens
tgccagcatatactgaagtcttttctgtcaccaaatttgtacctctaagt

SEQ ID NO: 231 - DNA, 50 bp, Homo sapiens
gctgcatatgagtaaagttaccccaaccacagtgaggaggaagatgttca

SEQ ID NO: 232 - DNA, 50 bp, Homo sapiens
aaacctccagtactttggttgacccttgtatgtcacagctctgctctatt

SEQ ID NO: 233 - DNA, 50 bp, Homo sapiens
acctgatcaatgacagagccttctgaggacattccaagacagtatacagt

SEQ ID NO: 234 - DNA, 50 bp, Homo sapiens
gcccttcccttcttggtttccaaaggcatttattgctgagttatatgttc

SEQ ID NO: 235 - DNA, 50 bp, Homo sapiens
ctgattgtagcagcctcgttagtgtcaccccctcctccctgatctgtcag

SEQ ID NO: 236 - DNA, 50 bp, Homo sapiens
accaaaaagaatagggaaaaacaagaatttcatgactctacctgtggtct

SEQ ID NO: 237 - DNA, 50 bp, Homo sapiens
gacttttccaaccctcatcaccaacgtctgtgccattttgtattttacta

SEQ ID NO: 238 - DNA, 50 bp, Homo sapiens
gctcgctaccagaaatcctaccgataagcccatcgtgactcaaaactcac

SEQ ID NO: 239 - DNA, 50 bp, Homo sapiens
acctgagtcccacaacaattgaaactgcaatgaagtctccttattctgct

SEQ ID NO: 240 - DNA, 50 bp, Homo sapiens
aattgatgaggatgctcctgggagggatgcgtgactatgtggtgttgcac

SEQ ID NO: 241 - DNA, 50 bp, Homo sapiens
tgaaatatgggaaagttgctgctattgattcagggtctgtcttggaggca

SEQ ID NO: 242 - DNA, 50 bp, Homo sapiens
caactgatagccacgctgaagaatggaaggaaaatttgcttggacctgca

SEQ ID NO: 243 - DNA, 50 bp, Homo sapiens
tgtgtaaatacataagcggcgtaagtttaaaggatgttggtgttccacgt

SEQ ID NO: 244 - DNA, 50 bp, Homo sapiens
aaccctcctccaatggaaattcccgtgttgcttcaaactgagacagatgg

SEQ ID NO: 245 - DNA, 60 bp, Homo sapiens
cctccaatggaaattcccgtgttgcttcaaactgagacagatgggacttaacaggcaatg

SEQ ID NO: 246 - DNA, 70 bp, Homo sapiens
ccaaccctcctccaatggaaattcccgtgttgcttcaaactgagacagatgggacttaacaggcaatggg

SEQ ID NO: 247 - DNA, 50 bp, Homo sapiens
aatcatcatctggatttaggaattgctcttgtcatacccccaagtttcta

SEQ ID NO: 248 - DNA, 50 bp, Homo sapiens
gcaagacatagaatagtgttggaaaatgtgcaatatgtgatgtggcaaat

SEQ ID NO: 249 - DNA, 50 bp, Homo sapiens
tctccatcttggtataaatacacttccacagtcagcacggggatcacaga

SEQ ID NO: 250 - DNA, 50 bp, Homo sapiens
tctccttactgggatagtcaggtaaacagttggtcaagactttgtaaaga

SEQ ID NO: 251 - DNA, 50 bp, Homo sapiens
acccatgatgagctcctcttcctggcttcttactgaaaggttaccctgta

SEQ ID NO: 252 - DNA, 50 bp, Homo sapiens
tgacatcatattctttcagagaagtgtcccaggacatgataataagatgc

SEQ ID NO: 253 - DNA, 50 bp, Homo sapiens
atcagaaaccgaagattaactacacagctccagaagactcagacctcaaa

SEQ ID NO: 254 - DNA, 50 bp, Homo sapiens
caggttcttaagggattctccgttttggttccattttgtacacgtttgga

SEQ ID NO: 255 - DNA, 50 bp, Homo sapiens
ctagaagatccacatcctctacaggtcggggaccaaaggctgattcttgg

SEQ ID NO: 256 - DNA, 50 bp, Homo sapiens
cttcttttgccatgtttccattctgccatcttgaattgtcttgtcagcca

SEQ ID NO: 257 - DNA, 50 bp, Homo sapiens
catggagacttgaggagggcttgaggttggtgaggttaggtgcgtgtttc

SEQ ID NO: 258 - DNA, 50 bp, Homo sapiens
cccatgtaagcaccccttcatttggcattccccacttgagaattaccctt

SEQ ID NO: 259 - DNA, 50 bp, Homo sapiens
cttgggccagactgtcagggttcaaggagggcatcaggagcagacggaga

SEQ ID NO: 260 - DNA, 50 bp, Homo sapiens
cctccgctcaactagcagatacagggatgaggcagacctgactctcttaa

SEQ ID NO: 261 - DNA, 50 bp, Homo sapiens
cagcggaacccttagcacccacatggaccaacagttcttccaaacttgac

SEQ ID NO: 262 - DNA, 50 bp, Homo sapiens
atgcctggtgcttccaaatattgttgacaactgtgactgtacccaaatgg

SEQ ID NO: 263 - DNA, 50 bp, Homo sapiens
cctctctccaaacccgttttccaacatttgttaatagttacgtctctcct

SEQ ID NO: 264 - DNA, 50 bp, Homo sapiens
tcatttgttgtgtgactgagtaaagaatttttggatcaagcggaaagagt

SEQ ID NO: 265 - DNA, 50 bp, Homo sapiens
tgaggatgtagagagaacaggtgggctgtattcacgccattggttggaag

SEQ ID NO: 266 - DNA, 50 bp, Homo sapiens
gaaattaaatgggttccaggtcttaaagaaagtgcagaagagatggtcaa

SEQ ID NO: 267 - DNA, 50 bp, Homo sapiens
aaccactatcatctacggcacaaacttgcaaaagctgtccacaccatttt

SEQ ID NO: 268 - DNA, 50 bp, Homo sapiens
cccgttttggggacgtgaacgttttaataatttttgctgaattctttaca

SEQ ID NO: 269 - DNA, 50 bp, Homo sapiens
tcagttttcaggagtgggttgatttcagcacctacagtgtacagtcttgt

SEQ ID NO: 270 - DNA, 50 bp, Homo sapiens
agcctatctgcttaagagactctggagtttcttatgtgccctggtggaca

SEQ ID NO: 271 - DNA, 50 bp, Homo sapiens
gagtagaaggacaacagggcagcaacttggagggagttctctggggatgg

SEQ ID NO: 272 - DNA, 50 bp, Homo sapiens
gttctggaactaaagggatctgaaacaacattcatgtgtgaatatgcaga

SEQ ID NO: 273 - DNA, 60 bp, Homo sapiens
tggaactaaagggatctgaaacaacattcatgtgtgaatatgcagatgagacagcaacca

SEQ ID NO: 274 - DNA, 70 bp, Homo sapiens
cagggacttaatcagcaatatcaacgtaatagttctggaactaaagggatctgaaacaacattcatgtgt

SEQ ID NO: 275 - DNA, 50 bp, Homo sapiens
acccattccatttatctttctacagggctgacattgtggcacattcttag

SEQ ID NO: 276 - DNA, 50 bp, Homo sapiens
tgaacctccaacagggaaggctctgtccagaaaggattgaatgtgaaacg

SEQ ID NO: 277 - DNA, 50 bp, Homo sapiens
tgaaggagatgatgagaatcttattccagggaccaacattaacacaacca

SEQ ID NO: 278 - DNA, 50 bp, Homo sapiens
ctctctggaggtactgagacagggtgctgatgggaaggaggggagccttt

SEQ ID NO: 279 - DNA, 50 bp, Homo sapiens
ctcttcggcaaatgtagcatgggcacctcagattgttgttgttaatgggc

SEQ ID NO: 280 - DNA, 50 bp, Homo sapiens
ttccagaaagaaaagatgagagggatgagaggcaagatatgaagatgaaa

SEQ ID NO: 281 - DNA, 50 bp, Homo sapiens
ggccagcctggacccaatcatgaggaagatgcagactcttatgagaacat

SEQ ID NO: 282 - DNA, 50 bp, Homo sapiens
aatgtttgcccagaataaagaaaataagctttgcacacactctcaattct

SEQ ID NO: 283 - DNA, 50 bp, Homo sapiens
gggaaagaaataccaaccctgcaataagtgtactaaactctacgctctgg

SEQ ID NO: 284 - DNA, 50 bp, Homo sapiens
caccagcgccttggctttgtgttagcatttcctcctgaagtgttctgttg

SEQ ID NO: 285 - DNA, 50 bp, Homo sapiens
acatcgtgattctccagctcaacgggtcggccaccatcaacgccaacgtg

SEQ ID NO: 286 - DNA, 50 bp, Homo sapiens
agctacgtatccatcgtgatggcatctacatggtacacatccaggtgacg

SEQ ID NO: 287 - DNA, 50 bp, Homo sapiens
ccacactgaatctcccctcctcacagttgccatgtagaccccttgaagag

SEQ ID NO: 288 - DNA, 60 bp, Homo sapiens
cagtcccccaccacactgaatctcccctcctcacagttgccatgtagaccccttgaagag

SEQ ID NO: 289 - DNA, 70 bp, Homo sapiens
ccatgtagaccccttgaagaggggaggggcctagggagccgcaccttgtcatgtaccatcaataaagtac

SEQ ID NO: 290 - DNA, 50 bp, Homo sapiens
ctcttcaaggggtctacatggcaactgtgaggaggggagattcagtgtgg

SEQ ID NO: 291 - DNA, 60 bp, Homo sapiens
ctcttcaaggggtctacatggcaactgtgaggaggggagattcagtgtggtgggggactg

SEQ ID NO: 292 - DNA, 70 bp, Homo sapiens
gtactttattgatggtacatgacaaggtgcggctccctaggcccctcccctcttcaaggggtctacatgg

SEQ ID NO: 293 - DNA, 50 bp, Homo sapiens
tttccttgttccctcccatgcctagctggattgcagagttaagtttatga

SEQ ID NO: 294 - DNA, 60 bp, Homo sapiens
tttccttgttccctcccatgcctagctggattgcagagttaagtttatgattatgaaata

SEQ ID NO: 295 - DNA, 70 bp, Homo sapiens
gttccatgttttccttgttccctcccatgcctagctggattgcagagttaagtttatgattatgaaataa

SEQ ID NO: 296 - DNA, 50 bp, Homo sapiens
tcataaacttaactctgcaatccagctaggcatgggagggaacaaggaaa

SEQ ID NO: 297 - DNA, 60 bp, Homo sapiens
tatttcataatcataaacttaactctgcaatccagctaggcatgggagggaacaaggaaa

SEQ ID NO: 298 - DNA, 70 bp, Homo sapiens
ttatttcataatcataaacttaactctgcaatccagctaggcatgggagggaacaaggaaaacatggaac

SEQ ID NO: 299 - DNA, 50 bp, Homo sapiens
gtcatccacctggccctcaaggagagaggcgggaggaagaagtagacaag

SEQ ID NO: 300 - DNA, 50 bp, Homo sapiens
tgactgaggaggagaagaatatcaaatggggttgagtgtgcagatctctg

SEQ ID NO: 301 - DNA, 50 bp, Homo sapiens
tggttttccaaaatgcacactgcgggttattgatttgttctttacaacta

SEQ ID NO: 302 - DNA, 50 bp, Homo sapiens
actgtcagcatgttgttgttgaagtgtggagttgtaactctgcgtggact

SEQ ID NO: 303 - DNA, 50 bp, Homo sapiens
tgagtcacatcctgggatccagtgtataaatccaatatcatgtcttgtgc

SEQ ID NO: 304 - DNA, 50 bp, Homo sapiens
gttctgctactgcgaattgatgacatcgtttcaggccacaaaaagaaagg

SEQ ID NO: 305 - DNA, 50 bp, Homo sapiens
acattcccttggatgtagtctgaggccccttaactcatctgttatcctgc

SEQ ID NO: 306 - DNA, 50 bp, Homo sapiens
actggcttccatcagtggtaactgctttggtctcttctttcatctgggga

SEQ ID NO: 307 - DNA, 50 bp, Arabidopsis thaliana
ccattggagaacttggcaactcacttggcggatccatggcacaacaacat

SEQ ID NO: 308 - DNA, 50 bp, Arabidopsis thaliana
ttttctcctttgtgtaattgtggattggatcttgtcctcttttgttccct

SEQ ID NO: 309 - DNA, 50 bp, Arabidopsis thaliana
tattctttcgtgtcagggcttgaaccaagtatccccgcttcttctacccc

SEQ ID NO: 310 - DNA, 50 bp, Arabidopsis thaliana
catcaagtgaagtggggaataacgacatcatttgcctgaagagtatggtt

SEQ ID NO: 311 - DNA, 50 bp, Arabidopsis thaliana
aatgagggcattggtttgctagttgctaattgatcagtgatgtattgtca

SEQ ID NO: 312 - DNA, 50 bp, Arabidopsis thaliana
tggaatcaacaagatggcttctttccccaccaaaactaagtgatcatcag

SEQ ID NO: 313 - DNA, 50 bp, Arabidopsis thaliana
tggaccgtaatgaatgaatgtacacgccataaacgccctttgttcaagca

SEQ ID NO: 314 - DNA, 50 bp, Arabidopsis thaliana
cctcactcttgtacccacggtagattcatgtaaaataccacttatgacgc

SEQ ID NO: 315 - DNA, 50 bp, Arabidopsis thaliana
ggttagcgaccttgttgttgttgttgtgttcttacatcttcttcttgaac

SEQ ID NO: 316 - DNA, 50 bp, Arabidopsis thaliana
ggcgaaaaggacggtcttgcttgtttgtaatttgtgtggagataaaaaga

SEQ ID NO: 317 - DNA, 50 bp, Homo sapiens; identical to SEQ ID NO: 128

SEQ ID NO: 318 - DNA, 50 bp, Homo sapiens
tgaaatatcagactagtgacaagctcctggtcttgagatgtcttctcgtt

SEQ ID NO: 319 - DNA, 60 bp, Homo sapiens
ggttgagttacttcctatcaagccagtaccgtgctaacaggctcaatattcctgaatgaa

SEQ ID NO: 320 - DNA, 70 bp, Homo sapiens
gttgagttacttcctatcaagccagtaccgtgctaacaggctcaatattcctgaatgaaatatcagacta

SEQ ID NO: 321 - DNA, 50 bp, Homo sapiens
aacgagaagacatctcaagaccaggagcttgtcactagtctgatatttca

SEQ ID NO: 322 - DNA, 60 bp, Homo sapiens
ttcattcaggaatattgagcctgttagcacggtactggcttgataggaagtaactcaacc

SEQ ID NO: 323 - DNA, 70 bp, Homo sapiens
tagtctgatatttcattcaggaatattgagcctgttagcacggtactggcttgataggaagtaactcaac

SEQ ID NO: 324 - DNA, 50 bp, Homo sapiens
tttcaagacagaaagtgacgcagagaacctccccggcccagtctcgacgc

SEQ ID NO: 325 - DNA, 50 bp, Homo sapiens
gcgtcgagactgggccggggaggttctctgcgtcactttctgtcttgaaa

SEQ ID NO: 326 - DNA, 50 bp, Homo sapiens
cctagacacctgcatcagtcaaggtcatggatattgggaagacagacagc

SEQ ID NO: 327 - DNA, 50 bp, Homo sapiens
gctgtctgtcttcccaatatccatgaccttgactgatgcaggtgtctagg

SEQ ID NO: 328 - DNA, 50 bp, Homo sapiens
aaataagaagaggaaagagagaggcctgccctaacccactgttgtgctga

SEQ ID NO: 329 - DNA, 50 bp, Homo sapiens
tcagcacaacagtgggttagggcaggcctctctctttcctcttcttattt

SEQ ID NO: 330 - DNA, 50 bp, Homo sapiens
ctcatgcctgcagtgctgctcatgttgcccccttggaattacttgttcaa

SEQ ID NO: 331 - DNA, 50 bp, Homo sapiens
ttgaacaagtaattccaagggggcaacatgagcagcactgcaggcatgag

SEQ ID NO: 332 - DNA, 50 bp, Homo sapiens
ccaatttctataattattgaacagcttttcgtggggccagcacaaagtct

SEQ ID NO: 333 - DNA, 50 bp, Homo sapiens
agactttgtgctggccccacgaaaagctgttcaataattatagaaattgg

SEQ ID NO: 334 - DNA, 50 bp, Homo sapiens
tggctacaaatagagtagagaacagactccagtcctcaaagactttcagt

SEQ ID NO: 335 - DNA, 50 bp, Homo sapiens
actgaaagtctttgaggactggagtctgttctctactctatttgtagcca

SEQ ID NO: 336 - DNA, 50 bp, Homo sapiens
agttaagatggaagaatatagagaccttctgaagagcactgtagcttgga

SEQ ID NO: 337 - DNA, 50 bp, Homo sapiens
tccaagctacagtgctcttcagaaggtctctatattcttccatcttaact

SEQ ID NO: 338 - DNA, 50 bp, Homo sapiens
cactcctatggcatgtggaagcaggtctgagcagtgtgcatagaagaaaa

SEQ ID NO: 339 - DNA, 50 bp, Homo sapiens
ttttcttctatgcacactgctcagacctgcttccacatgccataggagtg

SEQ ID NO: 340 - DNA, 50 bp, Homo sapiens
gctctccgttgacaatggccaaagaatagaagctctagaccttccttatt

SEQ ID NO: 341 - DNA, 50 bp, Homo sapiens
aataaggaaggtctagagcttctattctttggccattgtcaacggagagc

SEQ ID NO: 342 - DNA, 50 bp, Homo sapiens
ggcaaaacgcacctggcacaacagaacgaataatacagaagctggatgac

SEQ ID NO: 343 - DNA, 50 bp, Homo sapiens
gtcatccagcttctgtattattcgttctgttgtgccaggtgcgttttgcc

SEQ ID NO: 344 - DNA, 50 bp, Homo sapiens
tagccatttcttcctgattgtgcctagtatatcccagacagtttgtttct

SEQ ID NO: 345 - DNA, 50 bp, Homo sapiens
agaaacaaactgtctgggatatactaggcacaatcaggaagaaatggcta

SEQ ID NO: 346 - DNA, 50 bp, Homo sapiens
ggttggaatggtgatcgggatgcagtgagatactcttgtgagagggcaaa

SEQ ID NO: 347 - DNA, 50 bp, Homo sapiens
tttgccctctcacaagagtatctcactgcatcccgatcaccattccaacc

SEQ ID NO: 348 - DNA, 50 bp, Homo sapiens
gccatgagattcaacagtcaacatcagtctgataagctacccgacaaagt

SEQ ID NO: 349 - DNA, 50 bp, Homo sapiens
actttgtcgggtagcttatcagactgatgttgactgttgaatctcatggc

SEQ ID NO: 350 - DNA, 50 bp, Homo sapiens
aagaggacaagtttgagaggcaacacttaaacactagggctactgtggca

SEQ ID NO: 351 - DNA, 50 bp, Homo sapiens
tgccacagtagccctagtgtttaagtgttgcctctcaaacttgtcctctt

SEQ ID NO: 352 - DNA, 50 bp, Homo sapiens
atttgctttaaattgagtttccttgccattgcacactcctatctttctga

SEQ ID NO: 353 - DNA, 50 bp, Homo sapiens
tcagaaagataggagtgtgcaatggcaaggaaactcaatttaaagcaaat

SEQ ID NO: 354 - DNA, 50 bp, Homo sapiens
aaaagtcactaccaggctggcagggaatggggcaatctattcatactgat

SEQ ID NO: 355 - DNA, 50 bp, Homo sapiens
atcagtatgaatagattgccccattccctgccagcctggtagtgactttt

SEQ ID NO: 356 - DNA, 50 bp, Homo sapiens
atattgatttggatacggtgaataagctggacaagatgttgaggagaggg

SEQ ID NO: 357 - DNA, 50 bp, Homo sapiens
ccctctcctcaacatcttgtccagcttattcaccgtatccaaatcaatat

SEQ ID NO: 358 - DNA, 50 bp, Homo sapiens
aatgtgcaaggtgaaatgcttttggataaacgtaagcctattttctgacg

SEQ ID NO: 359 - DNA, 50 bp, Homo sapiens
cgtcagaaaataggcttacgtttatccaaaagcatttcaccttgcacatt

SEQ ID NO: 360 - DNA, 50 bp, Homo sapiens
ttcatctctaaggcacacttgctacccctctttgctgaccccagattgtg

SEQ ID NO: 361 - DNA, 50 bp, Homo sapiens
cacaatctggggtcagcaaagaggggtagcaagtgtgccttagagatgaa

SEQ ID NO: 362 - DNA, 50 bp, Homo sapiens
ttctggcaagctcttgtcatggtgttcgacacttccttctgtcttcttgg

SEQ ID NO: 363 - DNA, 50 bp, Homo sapiens
ccaagaagacagaaggaagtgtcgaacaccatgacaagagcttgccagaa

SEQ ID NO: 364 - DNA, 50 bp, Homo sapiens
ggtcaatgtagccaattatttgtttcaacagttgcagaacagatatttca

SEQ ID NO: 365 - DNA, 50 bp, Homo sapiens
tgaaatatctgttctgcaactgttgaaacaaataattggctacattgacc

SEQ ID NO: 366 - DNA, 50 bp, Homo sapiens
tgaaaagacagctaatttggtccaacaaacatgactgggtctagggcacc

SEQ ID NO: 367 - DNA, 50 bp, Homo sapiens
ggtgccctagacccagtcatgtttgttggaccaaattagctgtcttttca

SEQ ID NO: 368 - DNA, 50 bp, Homo sapiens
tggatcattgcccaaagttgcacgcactgactccttacctgtgaggaatg

SEQ ID NO: 369 - DNA, 50 bp, Homo sapiens
cattcctcacaggtaaggagtcagtgcgtgcaactttgggcaatgatcca

SEQ ID NO: 370 - DNA, 50 bp, Homo sapiens
ttaaaacattaaaagattgactccactttgtgccaagctctgcgggtagg

SEQ ID NO: 371 - DNA, 50 bp, Homo sapiens
cctacccgcagagcttggcacaaagtggagtcaatcttttaatgttttaa

SEQ ID NO: 372 - DNA, 50 bp, Homo sapiens
tgaatttggagtccctggcacataaatctaccttcaaatcagaggtcctt

SEQ ID NO: 373 - DNA, 50 bp, Homo sapiens
aaggacctctgatttgaaggtagatttatgtgccagggactccaaattca

SEQ ID NO: 374 - DNA, 50 bp, Homo sapiens
tgggtcagagacgaaaagggctattattaggtcaaacattacagaaatca

SEQ ID NO: 375 - DNA, 50 bp, Homo sapiens
tgatttctgtaatgtttgacctaataatagcccttttcgtctctgaccca

SEQ ID NO: 376 - DNA, 50 bp, Homo sapiens
ctgatttaacaggtggttctgcgggcgtccaggtcaacatctttttgtcc

SEQ ID NO: 377 - DNA, 50 bp, Homo sapiens
ggacaaaaagatgttgacctggacgcccgcagaaccacctgttaaatcag

SEQ ID NO: 378 - DNA, 50 bp, Homo sapiens
gtcactttagcgagcgggaaaacaatggcggaaagggaaaacctggaaag

SEQ ID NO: 379 - DNA, 50 bp, Homo sapiens
ctttccaggttttccctttccgccattgttttcccgctcgctaaagtgac

SEQ ID NO: 380 - DNA, 50 bp, Homo sapiens
taattaatagagctcacttaagattgcccatcaagaaacaggagggtggt

SEQ ID NO: 381 - DNA, 50 bp, Homo sapiens
accaccctcctgtttcttgatgggcaatcttaagtgagctctattaatta

SEQ ID NO: 382 - DNA, 50 bp, Homo sapiens
agtcctgctgaatcattggtttatagaagactatctggagggcctgatag

SEQ ID NO: 383 - DNA, 50 bp, Homo sapiens
ctatcaggccctccagatagtcttctataaaccaatgattcagcaggact

SEQ ID NO: 384 - DNA, 50 bp, Homo sapiens
atgtgattccatgataatcaaatagtgaatacattataaagtcagcaact

SEQ ID NO: 385 - DNA, 50 bp, Homo sapiens
atatatgggggctgggcctcgggactctcgctctaataaaggactgtagg

SEQ ID NO: 386 - DNA, 50 bp, Homo sapiens
ttttgacccagatgatggttcctttacagaacaataaaatggctgaacat

SEQ ID NO: 387 - DNA, 50 bp, Homo sapiens
tgagcactggaaacagtttcatggagtttaagttgagtgaacatcggcca

SEQ ID NO: 388 - DNA, 50 bp, Homo sapiens
atgcatttagtttttggcaccgtagtttaagggtgggattgccagttttt

SEQ ID NO: 389 - DNA, 50 bp, Homo sapiens
ggttgtgtctctggtttccccttttccccgtggttttaatttttaagaac

SEQ ID NO: 390 - DNA, 50 bp, Homo sapiens
ggaggacacccctgtgtgttgctgctgccttccgtgctgtctactgtatc

SEQ ID NO: 391 - DNA, 50 bp, Homo sapiens
gcatcagagagaatatggaaggacatcgaccctaacttcatccagtgagg

SEQ ID NO: 392 - DNA, 50 bp, Homo sapiens
accatagcagacagggtcagatggaatattagcggtttaggtgaagaacc

SEQ ID NO: 393 - DNA, 50 bp, Homo sapiens
agacagaagacaaggccaaatgggtgtctctggaatgatagacttagaaa

SEQ ID NO: 394 - DNA, 50 bp, Homo sapiens
atccacattcttacctttggtagtcaggtttggctactttgcagctcgcc

SEQ ID NO: 395 - DNA, 50 bp, Homo sapiens
atagcagtggattaccaacaccttgacttcttgtacagtgctaacatctt

SEQ ID NO: 396 - DNA, 50 bp, Homo sapiens
tagtaaaagtgaaagagaaagggtttttcctgccacaggatataactttt

SEQ ID NO: 397 - DNA, 50 bp, Homo sapiens
aaagcggtcgtttccccacaaggtgtccaactttgcggtactcacactta

SEQ ID NO: 398 - DNA, 50 bp, Homo sapiens
ctaggcccgcccaccccaaccttctggtggggagaaataaacggtttaga

SEQ ID NO: 399 - DNA, 50 bp, Homo sapiens
tgcactaaacagttgccccaaaagacatatcttgttttaaggcccagacc

SEQ ID NO: 400 - DNA, 50 bp, Homo sapiens
ttggatgaagctgaaaagacactaagaccttctgtgcctcagatccctga

SEQ ID NO: 401 - DNA, 50 bp, Homo sapiens
gtgtggcctaaggaacacctcttgtggggagtaagagccagcccttctcc

SEQ ID NO: 402 - DNA, 50 bp, Homo sapiens
aaggatgaaggactgatggagggcagaggaactggaggcagcaggcacaa

SEQ ID NO: 403 - DNA, 50 bp, Homo sapiens
agatgtctgtataaacaacctttgggtagcaggtggtcagttaggcagga

SEQ ID NO: 404 - DNA, 50 bp, Homo sapiens
tgcttgtcttttaaacaccttcacagatatcatttgcaccttgccaaagg

SEQ ID NO: 405 - DNA, 50 bp, Homo sapiens
gggtaggcagcttgcacccagttctcctttatctcaacttattttcctgg

SEQ ID NO: 406 - DNA, 50 bp, Homo sapiens
ccggtgtccctgagtgagggcaaagttgtaataacacttgttctctcctt

SEQ ID NO: 407 - DNA, 50 bp, Homo sapiens
acggcgttctgaaatttagcacactgggaagtccacatggttcatctgaa

SEQ ID NO: 408 - DNA, 50 bp, Homo sapiens
aatgagatcacagatggtgacactgagcggaaggatgcagtacctcggag

SEQ ID NO: 409 - DNA, 50 bp, Homo sapiens
tccttgcaaaacatttggctagtggtgttcagagaaataccaaaacgtgt

SEQ ID NO: 410 - DNA, 50 bp, Homo sapiens
ggcaaaggggaaggatgatgccatgtagatcctgtttgacatttttatgg

SEQ ID NO: 411 - DNA, 50 bp, Homo sapiens
actgttaaccaaattttgagcaaggagtctcaaaggtaattctgaaccag

SEQ ID NO: 412 - DNA, 50 bp, Homo sapiens
actagcagattgaatcgatattcattaagttaggaatggttggtggtcct

SEQ ID NO: 413 - DNA, 50 bp, Homo sapiens
aattgtgctttgtatcagtcagtgctggagaaatcttgaatagcttatgt

SEQ ID NO: 414 - DNA, 50 bp, Homo sapiens
aggaaaccaagccctcacaggaaagaaagcctgaatcaagaaaacaaagt

SEQ ID NO: 415 - DNA, 50 bp, Homo sapiens
actgagcaggacaactgacctgtctccttcacatagtccatatcaccaca

SEQ ID NO: 416 - DNA, 50 bp, Homo sapiens
gcgtaaaacgccagggccatcttcttacttaagccacatcctgaaccagg

SEQ ID NO: 417 - DNA, 50 bp, Homo sapiens
agcgacaagaaggaatctggtgaattttagtcatcccagctttttagtct

SEQ ID NO: 418 - DNA, 50 bp, Homo sapiens
gctggggctgagagagggtctgggttatctccttctgatcttcaaaacaa

SEQ ID NO: 419 - DNA, 50 bp, Homo sapiens
tcatggacacaaactttggagtataagcgacatcccttaagcaacaggct

SEQ ID NO: 420 - DNA, 50 bp, Homo sapiens
attcaagtcagggcctctctgcccttttccctccagaaacaaaaccaaga

SEQ ID NO: 421 - DNA, 50 bp, Homo sapiens
tgtttgtaccactagcattcttatgtctgtacttgaacgtgtagttagca

SEQ ID NO: 422 - DNA, 50 bp, Homo sapiens
aatatagctccactaaaggaccatagggaagagccagccttgccttttct

SEQ ID NO: 423 - DNA, 50 bp, Homo sapiens
gacagtccattaagttgatttccagtggtgaagggtcagacacgcctccc

SEQ ID NO: 424 - DNA, 50 bp, Homo sapiens
cctgggttgccttgtaatgaaaagggagatcgagccattgtaccacctta

SEQ ID NO: 425 - DNA, 50 bp, Homo sapiens
gttcactgtttaacagccagaagccagagcctgcgtactagaagtggatg

SEQ ID NO: 426 - DNA, 50 bp, Homo sapiens
ttgtcaagtggatctgccccaaagtttgctttgaggaaacgggcctccct

SEQ ID NO: 427 - DNA, 50 bp, Homo sapiens
cttgtatggaaaacagatgctgacagaattgtagactaccatgccacaca

SEQ ID NO: 428 - DNA, 50 bp, Homo sapiens
aaatctaagacacccaaacccctctttgtccctaagtagccctagcctgg

SEQ ID NO: 429 - DNA, 50 bp, Homo sapiens
agctgtttaattgaattggaatcgttccacttggaacccaagtttggaaa

SEQ ID NO: 430 - DNA, 50 bp, Homo sapiens
tttttctacgttatctcatctccttgttttcagtgtgcttcaataatgca

SEQ ID NO: 431 - DNA, 50 bp, Homo sapiens
ctcccatctgcacacctggatcaaggtagcctctctgcacaagggcaggt

SEQ ID NO: 432 - DNA, 50 bp, Homo sapiens
tgtttttgcttcctcagaaactttttattgcatctgccatccttcattgg

SEQ ID NO: 433 - DNA, 50 bp, Homo sapiens
acagccaactggaaagatataaaagtttgggtctgtctcctctccttcag

SEQ ID NO: 434 - DNA, 50 bp, Homo sapiens
actcctgctttagagagaagccaccatgaaaagtcctcatcatcagggga

SEQ ID NO: 435 - DNA, 50 bp, Homo sapiens
tccgtactgtatgtgatatagtgccattttcagtaactgctgtacacaca

SEQ ID NO: 436 - DNA, 50 bp, Homo sapiens
acttgccattacttttccttcccactctctccaacatcacattcacttta

SEQ ID NO: 437 - DNA, 50 bp, Homo sapiens
gtgagtgtgagcgagagggtgagtgtggtcagagtaaagctgctccaccc

SEQ ID NO: 438 - DNA, 50 bp, Homo sapiens
taatatgctggctttgcagcagaatgaaaaggatgagttggtgtagcctt

SEQ ID NO: 439 - DNA, 50 bp, Homo sapiens
ttccttccctggaggaactctttggttgcagggctaaacttagaggctgc

SEQ ID NO: 440 - DNA, 50 bp, Homo sapiens
tctgacggttgggagtggtggaaattggaaggataccaggaggtatttgg

SEQ ID NO: 441 - DNA, 50 bp, Homo sapiens
tgattacaaaaggcgtattctttcatggtttctgcaatgagaggaagtgt

SEQ ID NO: 442 - DNA, 50 bp, Homo sapiens
tcatgcattggattgctcagaataaagtgtctgttagacttcgttttggt

SEQ ID NO: 443 - DNA, 50 bp, Homo sapiens
tgacgttaacaccaggaatctccatgtttattatttttcgtggaaactcc

SEQ ID NO: 444 - DNA, 50 bp, Homo sapiens
ttgcaaagactcacgtttttgttgttttctcatcattccattgtgatact

SEQ ID NO: 445 - DNA, 50 bp, Homo sapiens
agctgtacatataacccttttctcctaaagaggagtcagtcagtgctcct

SEQ ID NO: 446 - DNA, 50 bp, Homo sapiens
agttcaggagatctctaagtgtagctgtaaattttggggttaatttggct

SEQ ID NO: 447 - DNA, 50 bp, Homo sapiens
tgtttggttgaggggtgcttttagttgtgtggcatttgtattcattgatc

SEQ ID NO: 448 - DNA, 50 bp, Homo sapiens
tcagcctgagtgagttcagcctgtaaaaaggatgttaagctgtgggtaaa

SEQ ID NO: 449 - DNA, 50 bp, Homo sapiens
aggggaaaagaggggagaaaaacaggagtgatgtcatttctttttcatgt

SEQ ID NO: 450 - DNA, 50 bp, Homo sapiens
actttctgcttgtagttgcttaaaattatgtattttgtcttgggctgcaa

SEQ ID NO: 451 - DNA, 50 bp, Homo sapiens
aagcaactgaatcttcagcatgttctcatcggcggagccttcttgtgtaa

SEQ ID NO: 452 - DNA, 50 bp, Homo sapiens
tgattggagcactgaggaacaagggaatgaaaaggcagactctctgaacg

SEQ ID NO: 453 - DNA, 50 bp, Homo sapiens
ttgtccaaacgaagcagccgtggtagtagctgtctatgattcttgctcag

SEQ ID NO: 454 - DNA, 50 bp, Homo sapiens
tggtgcaatagaagctgcaaagatgtgccactttatctatgaaatggagt

SEQ ID NO: 455 - DNA, 50 bp, Homo sapiens
ggcttccatgtccagaatcctgcttaaggttttagggtaccttcagtact

SEQ ID NO: 456 - DNA, 50 bp, Homo sapiens
ttttggccagcttttctagataaggttgtattgctactgcaactaacaaa

SEQ ID NO: 457 - DNA, 50 bp, Homo sapiens
cacacatcctggtacccttggtcttcaaaggccatttccagcagaccctc

SEQ ID NO: 458 - DNA, 50 bp, Homo sapiens
aaacatgtctttttctcgcctcaactttatccacatgaaatgtgtgccca

SEQ ID NO: 459 - DNA, 50 bp, Homo sapiens
taagcataaaacctgacacgttaaaatccctgccctttggtgagcccact

SEQ ID NO: 460 - DNA, 50 bp, Homo sapiens
aacttgcattttagcagtgcatgtttctaattgacttactgggaaactga

SEQ ID NO: 461 - DNA, 50 bp, Homo sapiens
aggcctcaggccacctccaggaacagaacacagttttaagtttgattttt

SEQ ID NO: 462 - DNA, 50 bp, Homo sapiens
tgagtcttagcaatatgggagcaggttttcactgaattctgagggtgcct

SEQ ID NO: 463 - DNA, 50 bp, Homo sapiens
gttgtcctggcacacaaggaggcgaggctatgcgttcgaggccaacctag

SEQ ID NO: 464 - DNA, 50 bp, Homo sapiens
tgggaacacatagaactgatggaggcttttcctaaggccaaggataatgt

SEQ ID NO: 465 - DNA, 50 bp, Homo sapiens
ggattgaacagttcagttgtatctatgccccacagtgaccagtaaagtcc

SEQ ID NO: 466 - DNA, 50 bp, Homo sapiens
cgatgactcattacccaatccccatgaacttgtttcagatttgctctgtt

SEQ ID NO: 467 - DNA, 50 bp, Homo sapiens
gtcgcaaaggggataatctgggaaagacaccaaatcatgggctcacttta

SEQ ID NO: 468 - DNA, 50 bp, Homo sapiens
actcaagctcacacctgtacctgatgggaatgaacataatgtgaagaaac

SEQ ID NO: 469 - DNA, 50 bp, Homo sapiens
caccaaaatagttatgttggcactgtgttcacacgcatggtccccacacc

SEQ ID NO: 470 - DNA, 50 bp, Homo sapiens
gtgcgctttcttttacaacaagcctctagaaacagatagtttctgagaat

SEQ ID NO: 471 - DNA, 50 bp, Homo sapiens
gtgtgtataatgtaaagtagttttgcatattcttgtgctgcacatgggct

SEQ ID NO: 472 - DNA, 50 bp, Homo sapiens
aggaatccttttctacatttgagcaaatactgaggttcatgttgtaccaa

SEQ ID NO: 473 - DNA, 50 bp, Homo sapiens
cgccttggctttgtgttagcatttcctcctgaagtgttctgttggcaata

SEQ ID NO: 474 - DNA, 50 bp, Homo sapiens
agagattttctattgctgggaaggtgtgtttctcccacaatttgtttgtg

SEQ ID NO: 475 - DNA, 50 bp, Homo sapiens
tgcaaccaaattggctttaccatcttggctttagtaggtatagaagacaa

SEQ ID NO: 476 - DNA, 50 bp, Homo sapiens
tgtcaaataaaagagaacgaacaggtagtttggtggagctgagctagtgt

SEQ ID NO: 477 - DNA, 50 bp, Homo sapiens
tcctgtagaaaacgaactgtaaaagaccatgcaagaggcaaaataaaact

SEQ ID NO: 478 - DNA, 50 bp, Homo sapiens
acagtagctttgtagtgggttttctgtgctgtgctttttaatttcatgta

SEQ ID NO: 479 - DNA, 50 bp, Homo sapiens
gattcctgtcatgaaggaaagcaagacagctcacagaccagcggcatctg

SEQ ID NO: 480 - DNA, 50 bp, Homo sapiens
ttttctgtacctttctaaacctctcttccctctgtgatggttttgtgttt

SEQ ID NO: 481 - DNA, 50 bp, Homo sapiens
aaatcttattcctcctcttctcccctcacttttccctacttcctctgcaa

SEQ ID NO: 482 - DNA, 50 bp, Homo sapiens
tggaatcagacatcttccagatggtttggaccctgtccatgtgtaggtca

SEQ ID NO: 483 - DNA, 50 bp, Homo sapiens
aatttagcacctcaggaataacttattggtttaggtcagttcttggcggg

SEQ ID NO: 484 - DNA, 50 bp, Homo sapiens
aaccatgtaactccattgaacatttttcaacttaaggtctgcatagcaga

SEQ ID NO: 485 - DNA, 50 bp, Homo sapiens
aaaccaggttaatggctaagaatgggtaacatgactcttgttggattgtt

SEQ ID NO: 486 - DNA, 50 bp, Homo sapiens
ctcttggctgagcttctacagggctgagagctgcgctttggggacttcag

SEQ ID NO: 487 - DNA, 50 bp, Homo sapiens
tttcctttggggcatgatgttttaacctttgctttagaagcacaagctgt

SEQ ID NO: 488 - DNA, 50 bp, Homo sapiens
atagaatgagcttggttaagcacctctcctttgcccttcaccctgactcc

SEQ ID NO: 489 - DNA, 50 bp, Homo sapiens
ttgagtagaactctgattttccctagaggccaaattctttttatctgggt

SEQ ID NO: 490 - DNA, 50 bp, Homo sapiens
ttctaaacacattcttgatcaccaaacaacttcagaaagacagtgactgt

SEQ ID NO: 491 - DNA, 50 bp, Homo sapiens
tggagttgcttccagctgccaaggcctgtgacagaattcgctgttaagag

SEQ ID NO: 492 - DNA, 50 bp, Homo sapiens
aatgatgcaaagttttattcttgaacttggacactgatgccatcaaacaa

SEQ ID NO: 493 - DNA, 50 bp, Homo sapiens
ggccagtaaattccatgtttttggctatatctcatccaaactgagcagtt

SEQ ID NO: 494 - DNA, 50 bp, Homo sapiens
ttcccattgtcctcctactcaactaaaattcatagttggctttaagccca

SEQ ID NO: 495 - DNA, 50 bp, Homo sapiens
gcatgtcctaatgcttgctgctgatttaaacacattaaaggtactttgca

SEQ ID NO: 496 - DNA, 50 bp, Homo sapiens
acaatggcataaaagtaactttctctgaagatgtgatgttcaggctgtga

SEQ ID NO: 497 - DNA, 50 bp, Homo sapiens
aatggaaggcaggtgaagatataaaaccctagaatgcttaaatgtgctgt

SEQ ID NO: 498 - DNA, 50 bp, Homo sapiens
ttaatgccagtcctcatgtaacctcaggtatcttcagcttgtggagaata

SEQ ID NO: 499 - DNA, 50 bp, Homo sapiens
tggagtatatgcctgaaaaggttttggattcagaaagaaaaaggatggtt

SEQ ID NO: 500 - DNA, 50 bp, Homo sapiens
aaagtaaggcatggttgtggttaatctggtttatttttgttccacaagtt

SEQ ID NO: 501 - DNA, 50 bp, Homo sapiens
ggtgtgtgtgtccagagtgagcaaggattatgtttttggattgtcaaaga

SEQ ID NO: 502 - DNA, 50 bp, Homo sapiens
aaccatttgcctctggctgtgtcacagggtgagccccaaaattggggttc

SEQ ID NO: 503 - DNA, 50 bp, Homo sapiens
gaaagtggagaggacctaacatatgtctctacctagaaaggatggtttca

SEQ ID NO: 504 - DNA, 50 bp, Homo sapiens
accaactataaacccagttctaaagttgtgtatgatggtgaacctttggg

SEQ ID NO: 505 - DNA, 50 bp, Homo sapiens
ggacctgagacactgtggctgtctaatgtaatcctttaaaaattctctgc

SEQ ID NO: 506 - DNA, 50 bp, Homo sapiens
tttggtgttcagttactgagtttcaaaaatgttttggtggcatgaggaca

SEQ ID NO: 507 - DNA, 50 bp, Homo sapiens
cctgtttaagaaagtgaaatgttatggtctcccctcttccaatgagctta

SEQ ID NO: 508 - DNA, 50 bp, Homo sapiens
acggaccaggccattcattattcctcaagtgttaatatactgacttatgc

SEQ ID NO: 509 - DNA, 50 bp, Homo sapiens
acagttttgtcaaaaagtgtatcttgaccccaccatcagtactccattct

SEQ ID NO: 510 - DNA, 50 bp, Homo sapiens
tttggttcatccgtgtgctgttcttttgggttctgagagggttttgccat

SEQ ID NO: 511 - DNA, 50 bp, Homo sapiens
ggcagtaatgcaagagtccttttgtgaagagtgtttctatgtagagatgt

SEQ ID NO: 512 - DNA, 50 bp, Homo sapiens
aaatgcagagcagaatggaccagtggatggacaaggagacaacccaggcc

SEQ ID NO: 513 - DNA, 50 bp, Homo sapiens
agtgttcctgctgccagttctttcctctttaggcgtggttgagaaaaagc

SEQ ID NO: 514 - DNA, 50 bp, Homo sapiens
cagtctctgccacttgtgctagtttttgtgtggtgtttagaaacatgggc

SEQ ID NO: 515 - DNA, 50 bp, Homo sapiens
ttccacttaggtttggcattttggcagataagctaatcttgtataaagca

SEQ ID NO: 516 - DNA, 50 bp, Homo sapiens
gtaaatgccctacatggtgtgatgctgcattatatataaaactgtgtgca

SEQ ID NO: 517 - DNA, 50 bp, Homo sapiens
agctcctgtgctgaccttcaagttacgttttggaactgtaatactaaagg

SEQ ID NO: 518 - DNA, 50 bp, Homo sapiens
acactagggaagaaccttaattctaaatttggttcatgtgtggcaaagtt

SEQ ID NO: 519 - DNA, 50 bp, Homo sapiens
taactggaatcactgccctgctgtaattaaacattctgtaccacatctgt

SEQ ID NO: 520 - DNA, 50 bp, Homo sapiens
cccccagtgctttgtagtctctcctatgtcataataaagctacattttct

SEQ ID NO: 521 - DNA, 50 bp, Homo sapiens
gacagacttggacacaaaaccgatccatagaagggcttcccaaaccttgt

SEQ ID NO: 522 - DNA, 50 bp, Homo sapiens
ccatatgtaacttgttttgaagagaagtgtttccgttgtgtgtcttgatg

SEQ ID NO: 523 - DNA, 50 bp, Homo sapiens
gtatcatctgccaagaccagggcctgcttcaccacagccacaataaagtc

SEQ ID NO: 524 - DNA, 50 bp, Homo sapiens
aatgaaccatttacagttcggttttggactctgagtcaaaggattttcct

SEQ ID NO: 525 - DNA, 50 bp, Homo sapiens
gccgagtcagcacatgggtagagatgatgtaaaagcagccaatctggaaa

SEQ ID NO: 526 - DNA, 50 bp, Homo sapiens
accttctgggaggagggtcggattcaatctgaacttagaactttcaactc

SEQ ID NO: 527 - DNA, 50 bp, Homo sapiens
gcaccatgtagaattttcactttgtactggcaggctcgttttacctcatt

SEQ ID NO: 528 - DNA, 50 bp, Homo sapiens
tctccagtcctgattactgtacacagtagctttagatggcgtggacgtga

SEQ ID NO: 529 - DNA, 50 bp, Homo sapiens
ttcctgttactggcatgtgcacgactatgttattagaagccactttatca

SEQ ID NO: 530 - DNA, 50 bp, Homo sapiens
gccagcttggaggatggacatttctggatacacatacacatacaaaacag

SEQ ID NO: 531 - DNA, 50 bp, Homo sapiens
tcagctccttgatctaagcctcccagagagacccctagaatgtttccctc

SEQ ID NO: 532 - DNA, 50 bp, Homo sapiens
ccggcggcaggaactatcagtagacagctgctgcttccatgaaacggaaa

SEQ ID NO: 533 - DNA, 50 bp, Homo sapiens
tgttgccttgaatataacagtacaatttgtcaattactctgcaccaggct

SEQ ID NO: 534 - DNA, 50 bp, Homo sapiens
aaaagtaacaccctccctttttcctgacagttctttcagctttacagaac

SEQ ID NO: 535 - DNA, 50 bp, Homo sapiens
aatgaaatgtagttgggttcttcctgtaatgcgctattatgtcttgggct

SEQ ID NO: 536 - DNA, 50 bp, Homo sapiens
aacctccttgtgtctgtttctctgttcctctgtggctgactcaataaact

SEQ ID NO: 537 - DNA, 50 bp, Homo sapiens
gtgggagggtgagatgtgaagatgtgggatgaacctggaatgaacgaatt

SEQ ID NO: 538 - DNA, 50 bp, Homo sapiens
ggcctaaagaaagctggggttaatcctgaagctaaaagtaaatgtttctt

SEQ ID NO: 539 - DNA, 50 bp, Homo sapiens
tcccatcctttccatcaagaccttcattagcttatgatatttgctgccga

SEQ ID NO: 540 - DNA, 50 bp, Homo sapiens
ggaggtctcttccagattgctcttctgccgaattatttgtatctattccg

SEQ ID NO: 541 - DNA, 50 bp, Homo sapiens
gcacacctcgtcagaggaccataaccgtgtggggacaataaccgcagggg

SEQ ID NO: 542 - DNA, 50 bp, Homo sapiens
acaatggatttgtgaagagcagattccatgagtaactctgacaggtattt

SEQ ID NO: 543 - DNA, 50 bp, Homo sapiens
tgagagacattgttaattttgggggaattggcattgcgaaagacttgaaa

SEQ ID NO: 544 - DNA, 50 bp, Homo sapiens
tgctagacatttctatactctgttgtaacactgaggtatctcatttgccc

SEQ ID NO: 545 - DNA, 50 bp, Homo sapiens
gtgggggatgggggttaaaaagtagagaacctcctttctgttcaactaat

SEQ ID NO: 546 - DNA, 50 bp, Homo sapiens
caggtgagtagttgccgcgtaatatcattggagtacattctttatactgt

SEQ ID NO: 547 - DNA, 50 bp, Homo sapiens
ccccaaccttattctgtgtgtagacattgtattccacaattttgaatggc

SEQ ID NO: 548 - DNA, 50 bp, Homo sapiens
cgaatggcttaaactaatttgctatgatcctctaacaccgaaatttccca

SEQ ID NO: 549 - DNA, 50 bp, Homo sapiens
agagggaatcagaaaaatgccaagccttttctctttgaatgtgctatttt

SEQ ID NO: 550 - DNA, 50 bp, Homo sapiens
cacccttctctgttaaccttgtgcctgtctcctgtatgatcacatcacca

SEQ ID NO: 551 - DNA, 50 bp, Homo sapiens
tgtgtctctgtcgcgtctgctgtgaagcacatgatgctctatttattgta

SEQ ID NO: 552 - DNA, 50 bp, Homo sapiens
tgagagtaagcacatgacagcgtctgcttgcgttgtgtctgttttatgtt

SEQ ID NO: 553 - DNA, 50 bp, Homo sapiens; identical to SEQ ID NO: 153

SEQ ID NO: 554 - DNA, 50 bp, Homo sapiens
tgcaacgaatatggataccacatagtactttggtgttacctgcttttgaa

SEQ ID NO: 555 - DNA, 50 bp, Homo sapiens
agaactgaatcagtcggaggaacctgaggcaggcgagagtagtactggag

SEQ ID NO: 556 - DNA, 50 bp, Homo sapiens
ttgccatgagataacacagtgtaaacagtagacacccagaaatcgtgact

SEQ ID NO: 557 - DNA, 50 bp, Homo sapiens
gctgttaggctaagagggtgcagggctagacacgaagcttaaactattca

SEQ ID NO: 558 - DNA, 50 bp, Homo sapiens
ccagtgtggaggtagcaaagcatctatctattctgaatcatgtttggaaa

SEQ ID NO: 559 - DNA, 50 bp, Homo sapiens
gccagtatgccacagaatgtcctaaacccttgctgcctcttatcaaaacc

SEQ ID NO: 560 - DNA, 50 bp, Homo sapiens
tttgtactgttgaaaccacttcattggacatgttgcaatagcaaaacccc

SEQ ID NO: 561 - DNA, 50 bp, Homo sapiens
agggggaacattgtaaagaaacaaaaaggtccagatgaatgtatgctaga

SEQ ID NO: 562 - DNA, 50 bp, Homo sapiens
ggtgctgaatatgtccttgtaggctctgttttaagaaaacaatatgtggg

SEQ ID NO: 563 - DNA, 50 bp, Homo sapiens
acattggcttgcttttgttaaagtgcaagtgttacatatggctttgtaca

SEQ ID NO: 564 - DNA, 50 bp, Homo sapiens
ttggtagtgtcagcgggcaccttttacaccttctagtagctcaagctagt

SEQ ID NO: 565 - DNA, 50 bp, Homo sapiens
tcctggaatcgtttaatctaaagcagtttcccctgttttggagattttgt

SEQ ID NO: 566 - DNA, 50 bp, Homo sapiens; identical to SEQ ID NO: 565

SEQ ID NO: 567 - DNA, 50 bp, Homo sapiens
tgagaaagtcctgtgcagtcctgagatgattactcttatttggtgtgctg

SEQ ID NO: 568 - DNA, 50 bp, Homo sapiens
tcgtcttttgcgaatggcttaattctgacactacctttctgggaaatgtt

SEQ ID NO: 569 - DNA, 50 bp, Homo sapiens
tttgattgtgtctgatgggaactgagttgttggcctttgtgaaatgaaat

SEQ ID NO: 570 - DNA, 50 bp, Homo sapiens
ttgacaaagcccaacaatgatctcaggaattacattttccaacagaccaa

SEQ ID NO: 571 - DNA, 50 bp, Homo sapiens
acctgtcacgcttctagttgcttcaaccattttataaccatttttgtaca

SEQ ID NO: 572 - DNA, 50 bp, Homo sapiens
tccttaaggtgcacagtaaatgtacagatagttataggccactgttttgt

SEQ ID NO: 573 - DNA, 50 bp, Homo sapiens
agctcatatgaacactgctctgaactcctctgacttagcattcaacttaa

SEQ ID NO: 574 - DNA, 50 bp, Homo sapiens
catgacaaacattactagcatgttcaactgcaccatgttctggcactgta

SEQ ID NO: 575 - DNA, 50 bp, Homo sapiens
acctctttcctaccaatttcacattttgcagaaacttgttcacatttcca

SEQ ID NO: 576 - DNA, 50 bp, Homo sapiens
gggttgtgtattaaatagccattcattctggaactcaaggacaggactgt

SEQ ID NO: 577 - DNA, 50 bp, Homo sapiens
gccttgcaggtgaccagcagtgtcattgtatttatatacagagcttatga

SEQ ID NO: 578 - DNA, 50 bp, Homo sapiens
ctggacgggcgtgggttctgggtcagcttcttttacctcaattttgtttg

SEQ ID NO: 579 - DNA, 50 bp, Homo sapiens
aaagtctgaggtgtggaacagttatttaagcattagtcaaccctggtcct

SEQ ID NO: 580 - DNA, 50 bp, Homo sapiens
tgggcaagacatgattaatgaatcagaatcctgtttcattggtgacttgg

SEQ ID NO: 581 - DNA, 50 bp, Homo sapiens
cctgtgtaaaagaagaaatacaagagactcaaacacctacacattcacgg

SEQ ID NO: 582 - DNA, 50 bp, Homo sapiens
tggcttgttcatcctccagatgtagctattgatgtacacttcgcaacgga

SEQ ID NO: 583 - DNA, 50 bp, Homo sapiens
aactatcagcttggatggtcacttgaatagaagatggttatacacagtgt

SEQ ID NO: 584 - DNA, 50 bp, Homo sapiens
ccacggtggaccctgtttgttttaaatattctgttcccatgtcaatcagt

SEQ ID NO: 585 - DNA, 50 bp, Homo sapiens
ttgtgtaggaaacttttgcagtttgacactaagataacttctgtgtgcat

SEQ ID NO: 586 - DNA, 50 bp, Homo sapiens
actcaaatcagttagcttcaaacaaaaacgaaagttagaccaagggaacg

SEQ ID NO: 587 - DNA, 50 bp, Homo sapiens; identical to SEQ ID NO: 586

SEQ ID NO: 588 - DNA, 50 bp, Homo sapiens
ttgtgtgctgtgcttcaaagccttaactgtcaaatcttgcattatcttgt

SEQ ID NO: 589 - DNA, 50 bp, Homo sapiens
acattatcatggcatgacttaagggaacattggtttgtgaaggaaaaaca

SEQ ID NO: 590 - DNA, 50 bp, Homo sapiens
tgtgtgactttcatgcttctggggttggagcttaaagatccaaactgaga

SEQ ID NO: 591 - DNA, 50 bp, Homo sapiens
tgctggtattctcactgccacatttttggaaacctgtattacaccttaaa

SEQ ID NO: 592 - DNA, 50 bp, Homo sapiens
ttgagtgtctgcagcagccctggacttccagacttctatcacatgagaaa

SEQ ID NO: 593 - DNA, 50 bp, Homo sapiens
tggtgctgatgcttagttgtctcatgccattaaattgtaaaagtgagttg

SEQ ID NO: 594 - DNA, 50 bp, Homo sapiens
ggaggtcagttgatttccccaggtacattcatggtgtgacagacacatgg

SEQ ID NO: 595 - DNA, 50 bp, Homo sapiens
agatcctttcagtccctagacctccattcactctgtttctcttctgctgg

SEQ ID NO: 596 - DNA, 50 bp, Homo sapiens
gatccgatcatggtgatgtacggggtgaattctcttgccgtgttgcaaat

SEQ ID NO: 597 - DNA, 50 bp, Homo sapiens
atggtttcaaaattcaaggtccccaaatggcagcattttatgttctgacc

SEQ ID NO: 598 - DNA, 50 bp, Homo sapiens
caagtatgtatgcaactttgcacaccaacaactgttaatctgtagctagt

SEQ ID NO: 599 - DNA, 50 bp, Homo sapiens
tggtgattctccaggccatttaataccctgcaatgtaattgtccctctgt

SEQ ID NO: 600 - DNA, 50 bp, Homo sapiens
ttctgcctcaatgtttactgtgcctttgtttttgctagtttgtgttgttg

SEQ ID NO: 601 - DNA, 50 bp, Homo sapiens
actactgtcacgtagctgtgtacaaagagatgtgaaatactttcaggcaa

SEQ ID NO: 602 - DNA, 50 bp, Homo sapiens
tgttgaacggttaaactgtgcatttctcattttgatgtgtcatgtatgtt

SEQ ID NO: 603 - DNA, 50 bp, Homo sapiens
aatggtcaaggttcagcatattctatatgaagatcacaaggtggtatcgt

SEQ ID NO: 604 - DNA, 50 bp, Homo sapiens
tgtgaacttgtgcgcaaatgtgcagattcaatgttcttgttacagattga

SEQ ID NO: 605 - DNA, 50 bp, Homo sapiens
ccccttgggctcagcacgaaagggctttcaatgaattaagtgaaaacttt

SEQ ID NO: 606 - DNA, 50 bp, Homo sapiens
aatgagttgtgttgaagcctccgtctcccatccttgcctgtagcccgtag

SEQ ID NO: 607 - DNA, 50 bp, Homo sapiens
agcctaaacatgtatactgtgcattttatgggtgactttgaaagatctgt

SEQ ID NO: 608 - DNA, 50 bp, Homo sapiens
accaggttttagcaaaatgcacacttttggctctttttggtatatgttct

SEQ ID NO: 609 - DNA, 50 bp, Homo sapiens
cctgactcctccttgcaaacaaaatgatagttgacactttatcctgattt

SEQ ID NO: 610 - DNA, 50 bp, Homo sapiens
ttgtattggcataatcagtgacttgtacattcagcaatagcatttgagca

SEQ ID NO: 611 - DNA, 50 bp, Homo sapiens
ttgttaagttgcaattactgcaatgacagaccaataaacaattgctgcca

SEQ ID NO: 612 - DNA, 50 bp, Homo sapiens
acagcaaactttggcatttatgtggagcatttctcattgttggaatctga

SEQ ID NO: 613 - DNA, 50 bp, Homo sapiens
tggtcattctgctgtgttcattaggtgccaatgtgaagtctggattttaa

SEQ ID NO: 614 - DNA, 50 bp, Homo sapiens
ggcatgaaatgagggacaaagaaagcatctcgtaggtgtgtctactgggt

SEQ ID NO: 615 - DNA, 50 bp, Homo sapiens
aatcttgacacatgcaattgtaaataaaagtcaccacttttgccaagctt

SEQ ID NO: 616 - DNA, 50 bp, Homo sapiens
tgatgccttcatctgttcagtcatctccaaaaacagtaaaaataaccact

SEQ ID NO: 617 - DNA, 50 bp, Homo sapiens
ggccaagctgaatgccatgaatatcagtgagacgcgttataaggaatcct

SEQ ID NO: 618 - DNA, 50 bp, Homo sapiens
cctgccagtgtcagaaaatcctatttatgaatcctgtcggtattccttgg

SEQ ID NO: 619 - DNA, 50 bp, Homo sapiens
tcaagaatttgggtgggagaaaagaaagtgggttatcaagggtgatttga

SEQ ID NO: 620 - DNA, 50 bp, Homo sapiens
caaactggtgcagaaattctataaactctttgctgtttttgatacctgct

SEQ ID NO: 621 - DNA, 50 bp, Homo sapiens
gctacttgtttacattgtacactgcgaccaccttgccgcttttcatcaca

SEQ ID NO: 622 - DNA, 50 bp, Homo sapiens
actggatgctacagacttataacagcatagtgaatggtaagactagtgca

SEQ ID NO: 623 - DNA, 50 bp, Homo sapiens
cctcccctatgcctcagccccatctctgctcctgtttgaattttgttatt

SEQ ID NO: 624 - DNA, 50 bp, Homo sapiens
ccagtgtgactagggatcctgagttttctgggacaattccagctttaatc

SEQ ID NO: 625 - DNA, 50 bp, Homo sapiens
tgacccttctttaagttatgtgtgtggggagaaatagaatggtgctctta

SEQ ID NO: 626 - DNA, 50 bp, Homo sapiens
gtgtgagtcctctgtttgcactggacatattccctacctgtcttatttca

SEQ ID NO: 627 - DNA, 50 bp, Homo sapiens
aggggaaggggtgcctggcgggtacttttctatcttttatttccagattt

SEQ ID NO: 628 - DNA, 50 bp, Homo sapiens
tcatgcttctgccctgtcaaaggtccctatttgaaatgtgttataataca

SEQ ID NO: 629 - DNA, 50 bp, Homo sapiens
agctagcagatcgtagctagtttgtattgtcttgtcaattgtacagactt

SEQ ID NO: 630 - DNA, 50 bp, Homo sapiens
agcccagaattcccaaaggcattaggtttcccaactgctttgtgctgata

SEQ ID NO: 631 - DNA, 50 bp, Homo sapiens
gtgtctatacatttctaagccttgtttgcagaataaacagggcatttagc

SEQ ID NO: 632 - DNA, 50 bp, Homo sapiens
tagaggtgtacagatgctatattatatccgctcccggtgtactgcagccc

SEQ ID NO: 633 - DNA, 50 bp, Homo sapiens
ttttacaaggaaggggtagtaattggcccactctcttcttactggaggct

SEQ ID NO: 634 - DNA, 50 bp, Homo sapiens
acacggtgaactggctgtgtccatctttgtcactgagtgaaatctctgtt

SEQ ID NO: 635 - DNA, 50 bp, Homo sapiens
tgaggacttggggcaggaaaggaatgctgctgaacttgaatttcccttta

SEQ ID NO: 636 - DNA, 50 bp, Homo sapiens
tcagaccttggatcagatgaactcttagaaatgaaggcagaaaaatgtca

SEQ ID NO: 637 - DNA, 50 bp, Homo sapiens
ccacgttcttgttccgatactctgagaagtgcctgatgttgatgtactta

SEQ ID NO: 638 - DNA, 50 bp, Homo sapiens
gcctgggtcagatttttattgtggggtgggatgagtaggacaacatattt

SEQ ID NO: 639 - DNA, 50 bp, Homo sapiens
gggtgcccacctgcatgtgaaggggaggcagttctcaatttatttcaata

SEQ ID NO: 640 - DNA, 50 bp, Homo sapiens
cagtcactgggtctatattaaacagcaaccagagcaacaaatggcaaaca

SEQ ID NO: 641 - DNA, 50 bp, Homo sapiens
tgacatggtagcagaaataggcccttttatgtgttgcttctattttacct

SEQ ID NO: 642 - DNA, 50 bp, Homo sapiens
agcaaagaacagtttggtggtcttttctcttccactgatttttctgtaat

SEQ ID NO: 643 - DNA, 50 bp, Homo sapiens
agccctgctaaactatgtacagaggaaactgttcaagtattggatttgaa

SEQ ID NO: 644 - DNA, 50 bp, Homo sapiens
tgtcaacgatgtttccagtagtgtttagatttggtgtcttcaaaggtagt

SEQ ID NO: 645 - DNA, 50 bp, Homo sapiens
ggctttttgcccatcaagaataaaaagaaataaaaccaaagggttaccgg

SEQ ID NO: 646 - DNA, 50 bp, Homo sapiens
tgcctgttgcacatcttgtaaaattggacaatggctctttagagagttat

SEQ ID NO: 647 - DNA, 50 bp, Homo sapiens
tgcggctagttcagagagatttttagagctgtggtggacttcatagatga

SEQ ID NO: 648 - DNA, 50 bp, Homo sapiens
aatggaaggattagtatggcctatttttaaagctgctttgttaggttcct

SEQ ID NO: 649 - DNA, 50 bp, Homo sapiens
ccatgtgggctactcatgatgggcttgattctttgggaataataaaatga

SEQ ID NO: 650 - DNA, 50 bp, Homo sapiens
aacgaggccagtggggaacccttacctaagtatgtgattgacaaatcatg

SEQ ID NO: 651 - DNA, 50 bp, Homo sapiens
cctctcaggacgtgccgggtttatcattgctttgttatttgtaaggactg

SEQ ID NO: 652 - DNA, 50 bp, Homo sapiens
ccactgcctgaaaggtttgtacagatgcatgccacagtagatgtccacat

SEQ ID NO: 653 - DNA, 50 bp, Homo sapiens
ttttgggataaattttactggttgctgttgtggagaaggtggcgtttcca

SEQ ID NO: 654 - DNA, 50 bp, Homo sapiens
tgaagtataagcctctactgggtctatattgtgaatcatcctgcctttca

SEQ ID NO: 655 - DNA, 50 bp, Homo sapiens
ctcgtctattggcccctgtagaaagttaacctttgttgttttccttttat

SEQ ID NO: 656 - DNA, 50 bp, Homo sapiens
tccccttctgtcccctagtaagcccagttgctgtatctgaacagtttgag

SEQ ID NO: 657 - DNA, 50 bp, Homo sapiens
aaacctatttcccttgcctcataggcttctgggatgtcatcacctccagt

SEQ ID NO: 658 - DNA, 50 bp, Homo sapiens
gaatttggtggtgtcaattgcttatttgttttcccacggttgtccagcaa

SEQ ID NO: 659 - DNA, 50 bp, Homo sapiens
ctattttgggtcatttttatgtacctttgggttcaggcattatttggggg

SEQ ID NO: 660 - DNA, 50 bp, Homo sapiens
taattgttgaacaggtgtttttccacaagtgccgcaaattgtaccttttt

SEQ ID NO: 661 - DNA, 50 bp, Homo sapiens
ccccctcagaagaatcatgaatttgcaacagacctaatttttggttactt

SEQ ID NO: 662 - DNA, 50 bp, Homo sapiens
ggcctttccattccatttattcacactgagtgtcctacaataaacttccg

SEQ ID NO: 663 - DNA, 50 bp, Homo sapiens
tggtgtctcaaaggagtaactgcagcttggtttgaaatttgtactgtttc

SEQ ID NO: 664 - DNA, 50 bp, Homo sapiens
tgccagtagtgaccaagaacacagtgattatatacactatactggaggga

SEQ ID NO: 665 - DNA, 50 bp, Homo sapiens
aggacacatctgacatcctgtgtttggttaaaatatacagcacattgtga

SEQ ID NO: 666 - DNA, 50 bp, Homo sapiens
tgggggttgtaaattggcatggaaatttaaagcaggttcttgttagtgca

SEQ ID NO: 667 - DNA, 50 bp, Homo sapiens
tgtgaaagaaacttgcttgcagctttaacaaaatgagaaacttcccaaat

SEQ ID NO: 668 - DNA, 50 bp, Homo sapiens
gtatatatcctccagcattcagtccagggggagccacggaaaccatgttc

SEQ ID NO: 669 - DNA, 50 bp, Homo sapiens
tgtgatgctaggaacatgagcaaactgaaaattactatgcacttgtcaga

SEQ ID NO: 670 - DNA, 50 bp, Homo sapiens
aacccagtatatctgtgttatctgatgggacggttgacagtggtcaggga

SEQ ID NO: 671 - DNA, 50 bp, Homo sapiens
atccagtggcctaggaattaaagtgttgttgtttttgctgttaaattgga

SEQ ID NO: 672 - DNA, 50 bp, Homo sapiens
gcattggcagcattgtgtctttgaccttgtatactagcttgacatagtgc

SEQ ID NO: 673 - DNA, 50 bp, Homo sapiens
tttcatggtgtgaaggaaggagcgtggtgcattggacatgggtctgacac

SEQ ID NO: 674 - DNA, 50 bp, Homo sapiens
agactgcacaaccaagaagttactcaaagctctgtgggagcccctgcctg

SEQ ID NO: 675 - DNA, 50 bp, Homo sapiens
cagtgctcacctaaatccatctgactacttgttcctgtgccctcttgttt

SEQ ID NO: 676 - DNA, 50 bp, Homo sapiens
gtgacgacgacctgaaggagacgggcttccaccttaccaccacgaaccag

SEQ ID NO: 677 - DNA, 50 bp, Homo sapiens
aacaggataaagctcgccgggaatgggaaagacagaagagaagggaaatg

SEQ ID NO: 678 - DNA, 50 bp, Homo sapiens
cctcacccccaccctcactttcaatccgtttgataccatttggctccttt

SEQ ID NO: 679 - DNA, 50 bp, Homo sapiens
atggaaagatgtggtctgagatgggtgctgcaaagatcataataaagtca

SEQ ID NO: 680 - DNA, 50 bp, Homo sapiens
ccatgacttcacagacatggtctagaatctgtacccttacccacatatga

SEQ ID NO: 681 - DNA, 50 bp, Homo sapiens
ctgtgaatgtttgcagtctcctaccgtctcaactacagctgcagttgcta

SEQ ID NO: 682 - DNA, 50 bp, Homo sapiens
cagcctgaattgcctctgggaagaggggtgggaatgacttttcaatgtac

SEQ ID NO: 683 - DNA, 50 bp, Homo sapiens
aatggcctagaatttgtggtagttgccaaagaggttctcctaggtggtct

SEQ ID NO: 684 - DNA, 50 bp, Homo sapiens
cagtgaaaagtttgtgagtgaagaatgctgagaagattgtaatgctttgt

SEQ ID NO: 685 - DNA, 50 bp, Homo sapiens
ttgtctcaaagctaccaagtttgtgcaataagtggaagggatgtcatcct

SEQ ID NO: 686 - DNA, 50 bp, Homo sapiens
acatcgaaggtgtgcatatatgttgaatgacattttagggacatggtgtt

SEQ ID NO: 687 - DNA, 50 bp, Homo sapiens
ggctatctcaggcaatatggccagcacctgggtctttatgcatgaagata

SEQ ID NO: 688 - DNA, 50 bp, Homo sapiens
gctgtcacggagcgactgtcgagatcgcctagtatgttctgtgaacacaa

SEQ ID NO: 689 - DNA, 50 bp, Homo sapiens
agctgctgacttgactgtcatcctgttcttgttagccattgtgaataaga

SEQ ID NO: 690 - DNA, 50 bp, Homo sapiens
ctcacaggtggactgagaaatcagttacatcttaagtgacctacagggta

SEQ ID NO: 691 - DNA, 50 bp, Homo sapiens
gtgcattgtatttagtctgtattgatcatggatgccctccttaatagcca

SEQ ID NO: 692 - DNA, 50 bp, Homo sapiens
cctgtacaattgcatcacgggtggggataaaaagaggaatattctggttt

SEQ ID NO: 693 - DNA, 50 bp, Homo sapiens
aaacagagctgtcttcagcaacattattagtagacaaagaggatgtggat

SEQ ID NO: 694 - DNA, 50 bp, Homo sapiens
actcaagttttcagtttgtaccgcctggtatgtctgtgtaagaagccaat

SEQ ID NO: 695 - DNA, 50 bp, Homo sapiens
tgactcctgccaagaaatcctttcttagaaggttgtttgattagttttgc

SEQ ID NO: 696 - DNA, 50 bp, Homo sapiens
ttgtattatctgctttgctgatgtagacaagagttaactgagtagcatgc

SEQ ID NO: 697 - DNA, 50 bp, Homo sapiens
aaagattgttggttaggccagattgacacctatttataaaccatatgcgt

SEQ ID NO: 698 - DNA, 50 bp, Homo sapiens
tggtaactgttccaggattgctccaggtttgagatggtattgctaaattt

SEQ ID NO: 699 - DNA, 50 bp, Homo sapiens
tgcaccttgtagtggattctgcatatcatctttcccacctaaaaatgtct

SEQ ID NO: 700 - DNA, 50 bp, Homo sapiens
cactagcacttgtgatgcaatagaacacttcgcctgtactgaaagggcca

SEQ ID NO: 701 - DNA, 50 bp, Homo sapiens
acgcaggctttcctatttctacaactgattgtacttatgcattttgtacc

SEQ ID NO: 702 - DNA, 50 bp, Homo sapiens
caggagctactttgagtttggtgttactaggatcagggtcagtctttggc

SEQ ID NO: 703 - DNA, 50 bp, Homo sapiens
tagagagaggcccgtggcctgaggtagtgcagaggaggatagtagagcag

SEQ ID NO: 704 - DNA, 50 bp, Homo sapiens
ttttggaagattttcagtctagttgccaaatctggctcctttacaaaaga

SEQ ID NO: 705 - DNA, 50 bp, Homo sapiens
aagttaattgaggcaatgtcatctgctcaaagttgagtggtttattcaca

SEQ ID NO: 706 - DNA, 50 bp, Homo sapiens
ttgcagtgtattactgtcagcagtatggtagctcaccgtggacgttcggc

SEQ ID NO: 707 - DNA, 50 bp, Homo sapiens
tattctgtgttaatggctaacctgttacactgggctgggttgggtagggt

SEQ ID NO: 708 - DNA, 50 bp, Homo sapiens
aaactgaatgagagaaaattgtataaccatcctgctgttcctttagtgca

SEQ ID NO: 709 - DNA, 50 bp, Homo sapiens
tgacactggtcttgcagtacaactggaagccaaaacaaggtggaagatgt

SEQ ID NO: 710 - DNA, 50 bp, Homo sapiens
ggtcaagtatatttggacctattatcctcggcaagccaagatgcaaacat

SEQ ID NO: 711 - DNA, 50 bp, Homo sapiens
agttcacaatatggttcaaatgtaacagtgcagaattgaatatggaggca

SEQ ID NO: 712 - DNA, 50 bp, Homo sapiens
ttgcatctttccaggagagcctcacattcttcttccaggttgtatcaccc

SEQ ID NO: 713 - DNA, 50 bp, Homo sapiens
gtgagtcaggagcaggagcgtgcggaccaaaaatcctcagcccttacgac

SEQ ID NO: 714 - DNA, 50 bp, Homo sapiens
tcaccttatgcaatgtgaattatcactacagaactccatcttactccaga

SEQ ID NO: 715 - DNA, 50 bp, Homo sapiens
tttgatgtaatataacctaacgttgtgctggtacctgttttaccatgtgt

SEQ ID NO: 716 - DNA, 50 bp, Homo sapiens
ctccatccctggccccctccctggatgacattaaagaagggttgagctgg

SEQ ID NO: 717 - DNA, 50 bp, Homo sapiens; identical to SEQ ID NO: 716

SEQ ID NO: 718 - DNA, 50 bp, Homo sapiens
ggcttagctgccagtctcccatttgtgacctatgccatccatctataatg

SEQ ID NO: 719 - DNA, 50 bp, Homo sapiens
ggccccaatgccaactcttaagtcttttgtaattctggctttctctaata

SEQ ID NO: 720 - DNA, 50 bp, Homo sapiens
tgtcaggtttgggtcttgggttcaagtgtatatattcctgtaagtttctt

SEQ ID NO: 721 - DNA, 50 bp, Homo sapiens; identical to SEQ ID NO: 75

SEQ ID NO: 722 - DNA, 50 bp, Homo sapiens
ttgacattctgcgaaagcaacaagcaaactgaagaccaactcctatgaga

SEQ ID NO: 723 - DNA, 50 bp, Homo sapiens
cgcctcttcaggttcttaagggattctccgttttggttccattttgtaca

SEQ ID NO: 724 - DNA, 50 bp, Homo sapiens
ccttgttggacagggggacaggctgcctactggaatgtaaatatgtgata

SEQ ID NO: 725 - DNA, 50 bp, Homo sapiens
tttctgaatgcctacctggcggtgtataccaggcagtgtcccagtttaaa

SEQ ID NO: 726 - DNA, 50 bp, Homo sapiens
tgtgcaaggggagcacatattggatgtatatgttaccatatgttaggaaa

SEQ ID NO: 727 - DNA, 50 bp, Homo sapiens
tcaagtgaacatctcttgccatcacctagctgcctgcacctgcccttcag

SEQ ID NO: 728 - DNA, 50 bp, Homo sapiens
ccgaggagaagcgcgagggctacgagcgtctcctgaagatgcaaaaccag

SEQ ID NO: 729 - DNA, 50 bp, Homo sapiens
gcagctgtttgaagtttgtatattttccgtactgcagagcttacacaaaa

SEQ ID NO: 730 - DNA, 50 bp, Homo sapiens
gcctgtgaaatagtactgcacttacataaagtgagacattgtgaaaaggc

SEQ ID NO: 731 - DNA, 50 bp, Homo sapiens
gctctgattgtacaagaattacctgtgctagtcaagttgttgtttttcct

SEQ ID NO: 732 - DNA, 50 bp, Homo sapiens
ctgtcttttgtagctctggactggaggggtagatggggagtcaattaccc

SEQ ID NO: 733 - DNA, 50 bp, Homo sapiens
ggtacaaccttcaactatttcttccatgcggaccccctcctgccaaaaga

SEQ ID NO: 734 - DNA, 50 bp, Homo sapiens
gcaattctccctgcgtcatggatttcaaggtcttttaatcaccttcggtt

SEQ ID NO: 735 - DNA, 50 bp, Homo sapiens
ccttcgctttaacataggtctaatttatttgccgtgccattttccataca

SEQ ID NO: 736 - DNA, 50 bp, Homo sapiens
tggttggaagtgggtggggttatgaaattgtagatgtttttagaaaaact

SEQ ID NO: 737 - DNA, 50 bp, Homo sapiens
accttcctccaggaaaagccattcaagcctgattatttttctaagtaact

SEQ ID NO: 738 - DNA, 50 bp, Homo sapiens
ctgtatagctttccccacctcccacaaaatcacccagttaatgtgtgtgt

SEQ ID NO: 739 - DNA, 50 bp, Homo sapiens
ggggtacctgtgttgagttgataaacatttccatcttcattaaaactgct

SEQ ID NO: 740 - DNA, 50 bp, Homo sapiens
tgtccacctttgcagcctgtttctgtcatgtagtttcaacaagtgctacc

SEQ ID NO: 741 - DNA, 50 bp, Homo sapiens
atgctacctcaaagtgctaccgataaacctttctaattgtaagtgccctt

SEQ ID NO: 742 - DNA, 50 bp, Homo sapiens
agcacccattccgaccatagtataatcatatcaaagggtgagaatcattt

SEQ ID NO: 743 - DNA, 50 bp, Homo sapiens
tgtggtttaagctgtactgaactaaatctgtggaatgcattgtgaactgt

SEQ ID NO: 744 - DNA, 50 bp, Homo sapiens
attacgaagatgaaccagtaaacgaggacatggagtgactatcggggcgg

SEQ ID NO: 745 - DNA, 50 bp, Homo sapiens
tcctccagctgacagaaaaatccaggatgagatcagaaggatactggtgt

SEQ ID NO: 746 - DNA, 50 bp, Homo sapiens
tttacacgccctgaagcagtcttctttgctagttgaattatgtggtgtgt

SEQ ID NO: 747 - DNA, 50 bp, Homo sapiens
gttcacggaaaagccagaacctgctgttttcagggtgggtgatgtaaata

SEQ ID NO: 748 - DNA, 50 bp, Homo sapiens
agtgctcttgctttggataactgtaaagggacccatgctgatagactgga

SEQ ID NO: 749 - DNA, 50 bp, Homo sapiens
tgccccagttgtcagtcagagccgttggtgtttttcattgtttaaaatgt

SEQ ID NO: 750 - DNA, 50 bp, Homo sapiens
aaaccaatggacaaacttcttgcttcaaggaacaaactcttaggttggca

SEQ ID NO: 751 - DNA, 50 bp, Homo sapiens
aaacatcatgagagtggaggcctgccacccagaaaggcacatactagtgc

SEQ ID NO: 752 - DNA, 50 bp, Homo sapiens
agtggattaacccctgcttctcttcttgttccctgttatcattcctcccc

SEQ ID NO: 753 - DNA, 50 bp, Homo sapiens
gtctgcttattcgtgtctcttactaggttcaatttcttggaggccgtgat

SEQ ID NO: 754 - DNA, 50 bp, Homo sapiens
tggcctgactgacatgcagttccataaatgcagatgtttgtctcattacc

SEQ ID NO: 755 - DNA, 50 bp, Homo sapiens
gccagacttgaaagagggctccagaaaaagtagatgcgtatctgtacaaa

SEQ ID NO: 756 - DNA, 50 bp, Homo sapiens
cgtcttaatgttcaccgtccacagctttggaataaaccatcctgggaagt

SEQ ID NO: 757 - DNA, 50 bp, Homo sapiens
ttaatgttcaccgtccacagctttggaataaaccatcctgggaagttgct

SEQ ID NO: 758 - DNA, 50 bp, Homo sapiens
tctagcccagcattgatctagaagcagaggaatcccagcgccttttaaaa

SEQ ID NO: 759 - DNA, 50 bp, Homo sapiens
ttgctcagcatgccagcctttaagattgaattagattgtgttgttgtggt

SEQ ID NO: 760 - DNA, 50 bp, Homo sapiens
aaaaggtatagaaatgctggttggaatgcttatttgaaaaagactggcca

SEQ ID NO: 761 - DNA, 50 bp, Homo sapiens
ctgcttcacgcctgtgtctccgcagcacttcatcgacctcttcaagtttt

SEQ ID NO: 762 - DNA, 50 bp, Homo sapiens
agagcagcttgtgtatgtaaacgcttcagtgaacttgctaatgatccaat

SEQ ID NO: 763 - DNA, 50 bp, Homo sapiens
tcaaacctactaatccagcgacaatttgaatcggttttgtaggtagagga

SEQ ID NO: 764 - DNA, 50 bp, Homo sapiens
tcaacctccgtcatgttttagaaaccttttatcttttccttcctcatgct

SEQ ID NO: 765 - DNA, 50 bp, Homo sapiens
tttccatctgtgtcccagattgtgaccctagactttcaattgacaagtaa

SEQ ID NO: 766 - DNA, 50 bp, Homo sapiens
catgtcgttagatggaacatggaagccattgtctaatcaactctatcatt

SEQ ID NO: 767 - DNA, 50 bp, Homo sapiens
atgtaatcctgtaggttggtacttcccccaaactgattataggtaacagt

SEQ ID NO: 768 - DNA, 50 bp, Homo sapiens
tgaatgatcagaactgacatttaattcatgtttgtctcgccatgcttctt

SEQ ID NO: 769 - DNA, 50 bp, Homo sapiens
tttgcacattttacatatgctatgtggttgcctttgggttttctgtacag

SEQ ID NO: 770 - DNA, 50 bp, Homo sapiens
tggtcatgttccaggtgctagtacatcattcatgatcaccttaatgctca

SEQ ID NO: 771 - DNA, 50 bp, Homo sapiens
agcataaagagttgtggatcagtagccattttagttactgggggtggggg

SEQ ID NO: 772 - DNA, 50 bp, Homo sapiens
tcaacactttgctttatttgacacaaccagactttctcagttcctgttct

SEQ ID NO: 773 - DNA, 50 bp, Homo sapiens
atgaagaaaatcattgagactgttgcagaaggagggggagaacttggagt

SEQ ID NO: 774 - DNA, 50 bp, Homo sapiens
actgaaagacttttgcttaaagtggcattattgactgctgatgtgatgct

SEQ ID NO: 775 - DNA, 50 bp, Homo sapiens
ttggttggtaactctgtaattcctaactatcactggtttggttctggact

SEQ ID NO: 776 - DNA, 50 bp, Homo sapiens
ccaccatatatactagctgttaatcctatggaatggggtattgggagtgc

SEQ ID NO: 777 - DNA, 50 bp, Homo sapiens
agaggaatctgaaagtgcagggtgttggttaaagttgtacctcccaagta

SEQ ID NO: 778 - DNA, 50 bp, Homo sapiens
tttttctccatcctgtttctagcacaaaaatttgcctgctgtgttacaaa

SEQ ID NO: 779 - DNA, 50 bp, Homo sapiens
cagattgatttgaaaggtgtgcagcctgatttaaaaccaaaccctgaacc

SEQ ID NO: 780 - DNA, 50 bp, Homo sapiens
gcaactaataagccaaggaatcgacatatattaggtgcgtgtactgtttc

SEQ ID NO: 781 - DNA, 50 bp, Homo sapiens
tgtccagtgataaatgtgattgatcttgccttttgtacatggaggtcacc

SEQ ID NO: 782 - DNA, 50 bp, Homo sapiens; identical to SEQ ID NO: 758

SEQ ID NO: 783 - DNA, 50 bp, Homo sapiens
agggaacagtgtggagatgtttttgtcttgtccaaataaaagattcacca

SEQ ID NO: 784 - DNA, 50 bp, Homo sapiens
acccattggtatacacagaatattcctgtgcccacacttaatgtcaatct

SEQ ID NO: 785 - DNA, 50 bp, Homo sapiens
ttgatgataccaccagtaaaaataggatgtttaccccaaaacaagtgtca

SEQ ID NO: 786 - DNA, 50 bp, Homo sapiens
tttcaaccgaaagggcagatccaatagaagacccgctccttaaataaaca

SEQ ID NO: 787 - DNA, 50 bp, Homo sapiens
acagaggcaaagttaagcttgatgatggttaaaatcggtttgatagcacc

SEQ ID NO: 788 - DNA, 50 bp, Homo sapiens
tggttgatttccctcattgtgtaaacattgacaggtatgtgacaaatggg

SEQ ID NO: 789 - DNA, 50 bp, Homo sapiens
cacaaactagattctggacaccagtgtgcggaaatgcttctgctacattt

SEQ ID NO: 790 - DNA, 50 bp, Homo sapiens
ggccctctttcctgtctgtgtaaattgttccgtgaagccgcgctctgttt

SEQ ID NO: 791 - DNA, 50 bp, Homo sapiens
cactgtcctttctccaggccctcagatggcacattagggtgggcgtgctg

SEQ ID NO: 792 - DNA, 50 bp, Homo sapiens
aggagctatgattagacttctgttagacttcctcactctatcacccacat

SEQ ID NO: 793 - DNA, 50 bp, Homo sapiens
acccactttctccttggtaaagcgtttacttaacaaaataatacccgaga

SEQ ID NO: 794 - DNA, 50 bp, Homo sapiens
gtcacacatgacacaagatgtacataatatcatgctcacgcctggagtgt

SEQ ID NO: 795 - DNA, 50 bp, Homo sapiens
atgtgcatgtgaatggcctagagaacctatttttgtgtctaaagtttaca

SEQ ID NO: 796 - DNA, 50 bp, Homo sapiens
agatcctgtcctcctttagcctcactaatcaagttgggtcctatcttccc

SEQ ID NO: 797 - DNA, 50 bp, Homo sapiens
agttgttagttgccctgctacctagtttgttagtgcatttgagcacacat

SEQ ID NO: 798 - DNA, 50 bp, Homo sapiens
aatcctttaactctgcggatagcatttggtaggtagtgattaactgtgaa

SEQ ID NO: 799 - DNA, 50 bp, Homo sapiens
ggaggaggagcttatttcttggtgtacttgaatcagaaggtccctgcaag

SEQ ID NO: 800 - DNA, 50 bp, Homo sapiens; identical to SEQ ID NO: 799

SEQ ID NO: 801 - DNA, 50 bp, Homo sapiens
aagtggaagtgggtgaattctactttttatgttggagtggaccaatgtct

SEQ ID NO: 802 - DNA, 50 bp, Homo sapiens
tgggattcattggcccataggtacattggaaaatgtatatctctccagct

SEQ ID NO: 803 - DNA, 50 bp, Homo sapiens
gggacccccaggaggctgaggatgggagacagagaccagactgtgacttg

SEQ ID NO: 804 - DNA, 50 bp, Homo sapiens
tgtttgtagcacacttgagtttgtgtattccattgacatcaaatgtgaca

SEQ ID NO: 805 - DNA, 50 bp, Homo sapiens
cgatctgtgtttgctctgacgaatggaatttatcctcacaaattggtgtt

SEQ ID NO: 806 - DNA, 50 bp, Homo sapiens
ccaggagcgtggttttctgattgtgatctgaggttctgccccaactgcac

SEQ ID NO: 807 - DNA, 50 bp, Homo sapiens
acattacctaatattctcactagctatgttctccaatccacactgccttt

SEQ ID NO: 808 - DNA, 50 bp, Homo sapiens
agacagccctgccaaagccataccaaagacactcaaagacagccaataaa

SEQ ID NO: 809 - DNA, 50 bp, Homo sapiens
agagatagcacagatggaccaaaggttatgcacaggtgggagtcttttgt

SEQ ID NO: 810 - DNA, 50 bp, Homo sapiens; identical to SEQ ID NO: 809

SEQ ID NO: 811 - DNA, 50 bp, Homo sapiens
gcctttcttcctctcccaacataacaatcgtggtaacagaatgcgactgc

SEQ ID NO: 812 - DNA, 50 bp, Homo sapiens
accgtgtaaagtggggatggggtaaaagtggttaacgtactgttggatca

SEQ ID NO: 813 - DNA, 50 bp, Homo sapiens
gcccagtgcttaaaaacgccttcttgcatgaggggattgaactatacaat

SEQ ID NO: 814 - DNA, 50 bp, Homo sapiens
gcgggaaggcatgtaaccacctaaaccatctccgagaacatcagaggatc

SEQ ID NO: 815 - DNA, 50 bp, Homo sapiens
tgtcaggctggcttggttaggttttactggggcagaggatagggaatctc

SEQ ID NO: 816 - DNA, 50 bp, Homo sapiens
ggtggattccaaatgaacccctgcgttagttacaaaggaaaccaatgcca

SEQ ID NO: 817 - DNA, 50 bp, Homo sapiens
atttatcgtaaacatccacgagtgctgttgcactaccatctatttgttgt

SEQ ID NO: 818 - DNA, 50 bp, Homo sapiens
tgggggttgtaaattggcatggaaatttaaagcaggttcttgttggtgca

SEQ ID NO: 819 - DNA, 50 bp, Homo sapiens
gataggggcggcccggagccagccaggcagttttattgaaatctttttaa

SEQ ID NO: 820 - DNA, 50 bp, Homo sapiens
catttgtaccctaggcccacgaacccacgagaatgtcctctgacttccag

SEQ ID NO: 821 - DNA, 50 bp, Homo sapiens
agtgggattttatgccagttgttaaaatgagcattgatgtacccattttt

SEQ ID NO: 822 - DNA, 50 bp, Homo sapiens
ctttcctttgctccctcccatgtttctggtggactaaattgtgtatctgg

SEQ ID NO: 823 - DNA, 50 bp, Homo sapiens
agttttctagattgtcacatgctttgtgactaatgcaagaaagcaagtcc

SEQ ID NO: 824 - DNA, 50 bp, Homo sapiens
gaaacactttcaggaccttccttcctcttgcagttgttctttaatctcct

SEQ ID NO: 825 - DNA, 50 bp, Homo sapiens
ctcgaggggccaattacaggagcacaggaaggttctgattacacacctct

SEQ ID NO: 826 - DNA, 50 bp, Homo sapiens
ttgagttaagttgcatttctttgggctatgaaggagtcctcttaagtttg

SEQ ID NO: 827 - DNA, 50 bp, Homo sapiens
agggattgtttctggaccagtttgtctaagtcctggctcttattggttca

SEQ ID NO: 828 - DNA, 50 bp, Homo sapiens
tgaactgctgctacatccagacactgtgcaaataaattatttctgctacc

SEQ ID NO: 829 - DNA, 50 bp, Homo sapiens
actatgcagtttttcttgaaggaactaaaagcaactagctccctaatggt

SEQ ID NO: 830 - DNA, 50 bp, Homo sapiens
gtctttccagcatccactctcccttgtcctcctgggggcatatctcagtc

SEQ ID NO: 831 - DNA, 50 bp, Homo sapiens
gcagtaggtaggctcacttctctttcccttcaaaatgcttttcataggct

SEQ ID NO: 832 - DNA, 50 bp, Homo sapiens
tctgctgttgggctggtgtgtggacagaaggaatggaaagccaaattaat

SEQ ID NO: 833 - DNA, 50 bp, Homo sapiens
ccacttggaataggaatatcacccctatcttggaagaccaggtggaggct

SEQ ID NO: 834 - DNA, 50 bp, Homo sapiens
gccctatggcgttgttaaacacgagcgtatgctagtaagtatcattcata

SEQ ID NO: 835 - DNA, 50 bp, Homo sapiens
gtgggtgcatggggctgtggagtgggtgtcagtatggatgtgtctgaatg

SEQ ID NO: 836 - DNA, 50 bp, Homo sapiens
cattcgtctgtatgcccagtcccatccgtgtcctgctgtaactacataga

SEQ ID NO: 837 - DNA, 50 bp, Homo sapiens
tgtctgcttcttccattttctcgtctctctcccctcttcccccattatcc

SEQ ID NO: 838 - DNA, 50 bp, Homo sapiens; identical to SEQ ID NO: 580

SEQ ID NO: 839 - DNA, 50 bp, Homo sapiens
ccagattagggtggctgtccatccctggatagctatttgcacgaatcatg

SEQ ID NO: 840 - DNA, 50 bp, Homo sapiens
cggagctctggctctgctgtaggaagcccggtacgtccttcatgacagca

SEQ ID NO: 841 - DNA, 50 bp, Homo sapiens
gcactgaatatcgaacaagcactcaaattgaagtatcagtcatgttttgt

SEQ ID NO: 842 - DNA, 50 bp, Homo sapiens
agctcgaggtgtcctgcacttttcttataaggctactgaagttacatgtt

SEQ ID NO: 843 - DNA, 50 bp, Homo sapiens
tgccattggaatgtttctacacgatcctattaagaataatgtgatgccct

SEQ ID NO: 844 - DNA, 50 bp, Homo sapiens
ggataacaagtaaatgtctgaaagcatgaggggctttatttgcctttacc

SEQ ID NO: 845 - DNA, 50 bp, Homo sapiens; identical to SEQ ID NO: 28

SEQ ID NO: 846 - DNA, 50 bp, Homo sapiens
aaaactcatctcagaagaggatctgaatggggccgcacatcaccatcatc

SEQ ID NO: 847 - DNA, 50 bp, Homo sapiens
aaacccctttaaatgagggccagtattatctctgctttcagaagtagaca

SEQ ID NO: 848 - DNA, 50 bp, Homo sapiens
gacctgactccactcttaaacctgggtcttctccttggcggtgctgtcag

SEQ ID NO: 849 - DNA, 50 bp, Homo sapiens
cttttatagcagtttatggggagcacttgaaagagcgtgtgtacatgtat

SEQ ID NO: 850 - DNA, 50 bp, Homo sapiens
agatcctgaaagtagctgcctgtgacccagtgaagccatatcaaaagtgg

SEQ ID NO: 851 - DNA, 50 bp, Homo sapiens
tactgctaagtgcttggttggggtggtgagatgatgattagatcaggggt

SEQ ID NO: 852 - DNA, 50 bp, Homo sapiens
ttgtacccagagactatgatttatattgattgcacttgcctgccatgatt

SEQ ID NO: 853 - DNA, 50 bp, Homo sapiens
tttcagatgcttctgggagacaccaaagggtgaagctatttatctgtagt

SEQ ID NO: 854 - DNA, 50 bp, Homo sapiens
ttgtggtaatatgatgtgcctttccttgcctaaatcccttcctggtgtgt

SEQ ID NO: 855 - DNA, 50 bp, Homo sapiens
cacaaggtgcgcggttaccgctacttggaggaggacaactcggacgagag

SEQ ID NO: 856 - DNA, 50 bp, Homo sapiens
tagactcacgaacaaatccacctgagatcagcagagccaccctagatcag

SEQ ID NO: 857 - DNA, 50 bp, Homo sapiens
cctcagaggcttactctaacccatcccagaataaatggagacttcatgtg

SEQ ID NO: 858 - DNA, 50 bp, Homo sapiens
aggctgttgatgcttattctctgtaactaagaattttaccttttggggga

SEQ ID NO: 859 - DNA, 50 bp, Homo sapiens
gtaaacgtatcctctgtattcagtaaacaggctgcctctccagggagggc

SEQ ID NO: 860 - DNA, 50 bp, Homo sapiens
aactaaccccctttccctgctagaaataacaattagatgccccaaagcga

SEQ ID NO: 861 - DNA, 50 bp, Homo sapiens
gcctcgacacatcctcatccccagcatgggacacctcaagatgaataata

SEQ ID NO: 862 - DNA, 48 bp, Homo sapiens
gcacagtcacattccctccttaggaatcttccccttccaccctttaca

SEQ ID NO: 863 - DNA, 50 bp, Homo sapiens
tttgaggttctttggttttgttagtaaaagccagttctgtggtgatgacc

SEQ ID NO: 864 - DNA, 50 bp, Homo sapiens
catctgaagtgtggagccttacccatttcatcacctacaacggaagtagt

SEQ ID NO: 865 - DNA, 50 bp, Homo sapiens
ttttggcagttgtctgcattaacctgttcatacacccattttgtcccttt

SEQ ID NO: 866 - DNA, 50 bp, Homo sapiens
tggtgtttatgtactactctatagaactcttggcttgcacttctacagct

SEQ ID NO: 867 - DNA, 50 bp, Homo sapiens; identical to SEQ ID NO: 131

SEQ ID NO: 868 - DNA, 50 bp, Homo sapiens
tggtctccttggaaatccgtctagttaacatttcaagggcaataccgtgt

SEQ ID NO: 869 - DNA, 50 bp, Homo sapiens
gtctaccaggcgaaaaccacagattctccttctagttagtatagcggact

SEQ ID NO: 870 - DNA, 50 bp, Homo sapiens
acttctcttgatgtagaaagagatgacgttgttaccctgagtgacagtca

SEQ ID NO: 871 - DNA, 50 bp, Homo sapiens
tgagctaagtgtcatgcatatttgtgaagaaacacccttgtttggtccct

SEQ ID NO: 872 - DNA, 50 bp, Homo sapiens
ctgagcaaggcagatgacctaatcacctcacgacagcaatacagcagtga

SEQ ID NO: 873 - DNA, 50 bp, Homo sapiens
tttgtactattgctagaccctcttctgtaatgggtaatgcgtttgattgt

SEQ ID NO: 874 - DNA, 50 bp, Homo sapiens
tgctatgctaatgtctagaaaggcatacgatgctactattatgctctgtt

SEQ ID NO: 875 - DNA, 50 bp, Homo sapiens
actgctctttctcaggcccaaggtaaaaaggtttttggtctcatgttgac

SEQ ID NO: 876 - DNA, 50 bp, Homo sapiens
tcaccagctgatgacacttccaaagagattagctcacctttctcctaggc

SEQ ID NO: 877 - DNA, 50 bp, Homo sapiens; identical to SEQ ID NO: 116

SEQ ID NO: 878 - DNA, 50 bp, Homo sapiens
tgcatgaagcactgtttttaaacccaagtaaagactgcttgaaacctgtt

SEQ ID NO: 879 - DNA, 50 bp, Homo sapiens
tgattttgcaacttaggatgtttttgagtcccatggttcattttgattgt

SEQ ID NO: 880 - DNA, 50 bp, Homo sapiens
tttgagcgatctctcacatgatggggttctttagtacatggtaacagcca

SEQ ID NO: 881 - DNA, 50 bp, Homo sapiens
cccggcctgggactcagcatttctgatatgccttaagaattcattctgtt

SEQ ID NO: 882 - DNA, 50 bp, Homo sapiens
agttttgctgaagactggccttattaatggacagctttcctaacaagaga

SEQ ID NO: 883 - DNA, 50 bp, Homo sapiens
gggtcaatagtttcccaatttcaggatatttcgatgtcagaaataacgca

SEQ ID NO: 884 - DNA, 50 bp, Homo sapiens
tgagagctgaaatgagaccatttactttgtttaaaatgctgtactgtgca

SEQ ID NO: 885 - DNA, 50 bp, Homo sapiens
ttgagctaagaccttaggaaattcactttctgcatgataaaatgacccaa

SEQ ID NO: 886 - DNA, 50 bp, Homo sapiens
tgtcattgtacactttatttccctcacactgtgttatgctctgatgtgct

SEQ ID NO: 887 - DNA, 50 bp, Homo sapiens
ggtctctttgactaatcaccaaaaagcaaccaacttagccagttttattt

SEQ ID NO: 888 - DNA, 50 bp, Homo sapiens
aggttcttcctgtacatacgtgtatatatgtgaacagtgagatggccgtt

SEQ ID NO: 889 - DNA, 50 bp, Homo sapiens
acttggatgctgccgctactgaatgtttacaaattgcttgcctgctaaag

SEQ ID NO: 890 - DNA, 50 bp, Homo sapiens
gggaggcgtggctgagaccaactggtttgcctataatttattaactattt

SEQ ID NO: 891 - DNA, 50 bp, Homo sapiens
tctcccagaatgtacttatcttacctcggcatgtactgtagtcactcagt

SEQ ID NO: 892 - DNA, 50 bp, Homo sapiens
tgtgcactgttgtaaaccattcagaattttcctgctaggcccttgatgct

SEQ ID NO: 893 - DNA, 50 bp, Homo sapiens
catcggccagacagagttgaatgcaagcaatccagaagaagtgttacagc

SEQ ID NO: 894 - DNA, 50 bp, Homo sapiens
tgctctagccatcaggttctttcaaatgcatctttacactcttgcacaaa

SEQ ID NO: 895 - DNA, 50 bp, Homo sapiens
tgagcatgaaatgggatcctgcatcacttgttttaactatttattttgcc

SEQ ID NO: 896 - DNA, 50 bp, Homo sapiens
tttgcggctagttggctattcaagaaacctcgcccctctgaatgtcatac

SEQ ID NO: 897 - DNA, 50 bp, Homo sapiens
gtttacgtggaagaaacgctaagggtttgctcccaggaaaggagaggaag

SEQ ID NO: 898 - DNA, 50 bp, Homo sapiens
tgctcaaatcaggacttaaatcataggcaccacatttttcatgtcagact

SEQ ID NO: 899 - DNA, 50 bp, Homo sapiens
tgaaattctacccatcttgagggaggaccgttcctcagttaaggacttgt

SEQ ID NO: 900 - DNA, 50 bp, Homo sapiens
atgagtgtgtcggaatcccgtgcttaaaatacgctcttaaattattttct

SEQ ID NO: 901 - DNA, 50 bp, Homo sapiens
aaatcagaactgaggtagcttagagatgtagcgatgtaagtgtcgatgtt

SEQ ID NO: 902 - DNA, 50 bp, Homo sapiens
aggctttagcaaagatggatatattggtgactgagacagaagaactggca

SEQ ID NO: 903 - DNA, 50 bp, Homo sapiens
agtgggcctaactcatgtgagcttgataactgatgaactcattgggagca

SEQ ID NO: 904 - DNA, 50 bp, Homo sapiens
aacactaacctctcccctcctggctcaagaattactccgaagtcagtctg

SEQ ID NO: 905 - DNA, 50 bp, Homo sapiens
tctgtcaggaaatgtaactttggttttatttttggcttattccaaggggt

SEQ ID NO: 906 - DNA, 50 bp, Homo sapiens
aaattgtgccggacttacctttcattgaacatgctgccataacttagatt

SEQ ID NO: 907 - DNA, 50 bp, Homo sapiens
tggcagggagctgggacctggagagacaactcctgtaaataaaacacttt

SEQ ID NO: 908 - DNA, 50 bp, Homo sapiens
agggagataatggagtccactttaatttggaattctgtgtgagctatgat

SEQ ID NO: 909 - DNA, 50 bp, Homo sapiens
agatcagtgatactggtgttagtgttgtaatcaggttaaacccacttcca

SEQ ID NO: 910 - DNA, 50 bp, Homo sapiens
ccatttgacagtaaaggctcttggcttctgttggaggcatgggaaattgt

SEQ ID NO: 911 - DNA, 50 bp, Homo sapiens
tttaacagcctgtcctcccggcatcaggagtcattgaacaatcatggatt

SEQ ID NO: 912 - DNA, 50 bp, Homo sapiens
aatacttattgtttggcaggtcatccacacacttctgcccccactgcatt

SEQ ID NO: 913 - DNA, 50 bp, Homo sapiens
ttatcagatgggatactggggactataaacaatggaaataaagccactgt

SEQ ID NO: 914 - DNA, 50 bp, Homo sapiens
ccctgtgcctttcctttgagagtgaaggtgggtggagttgaccagagaaa

SEQ ID NO: 915 - DNA, 50 bp, Homo sapiens
tgtgtgcgtagaatattacgtatgcatgttcatgtctaaagaatggctgt

SEQ ID NO: 916 - DNA, 50 bp, Homo sapiens
tctacatgtgactggctttcttgccctcgtctcttgaatgtttagactct

SEQ ID NO: 917 - DNA, 50 bp, Homo sapiens
tggtacccaaactcaccatttggtcctctttaatctttgagggtttcaat

SEQ ID NO: 918 - DNA, 50 bp, Homo sapiens
ttccatttattcatgtacattggccagttcctggtccttgtctgacttct

SEQ ID NO: 919 - DNA, 50 bp, Homo sapiens
aaccatctggagtcagtacagatcatcaatccttccacatatacaagttc

SEQ ID NO: 920 - DNA, 50 bp, Homo sapiens
ggccacctgctgactatttgtggtttaaaataaaaggtttacttgtctgc

SEQ ID NO: 921 - DNA, 50 bp, Homo sapiens
tctttgtaaagcacgatgatacaaatctggtgccagtgttatattttgca

SEQ ID NO: 922 - DNA, 50 bp, Homo sapiens
catggatatcatgtatccttcctggtgctcacacacctgtcaccttgtaa

SEQ ID NO: 923 - DNA, 50 bp, Homo sapiens
ataaggtgcataaaacccttaaattcatctagtagctgttcccccgaaca

SEQ ID NO: 924 - DNA, 50 bp, Homo sapiens
tggaccggagtctgctgagtttataaggttccaaaaatatggtaaaatct

SEQ ID NO: 925 - DNA, 50 bp, Homo sapiens
actcgaccttggtaaacggaaatgttgggggtgaagagaaacaatcacta

SEQ ID NO: 926 - DNA, 50 bp, Homo sapiens
ttcaaggttctgcgaaattaattgggcaggttaattgtgtacctgaaact

SEQ ID NO: 927 - DNA, 50 bp, Homo sapiens
tccccaggatggggcctcatacaacccttcatctgcactcaacatttaat

SEQ ID NO: 928 - DNA, 50 bp, Homo sapiens
ttttagacatggagtgcaggtggacactgtgtgaactgtttttggtcagt

SEQ ID NO: 929 - DNA, 50 bp, Homo sapiens
caagaaacttggtctgcagtctggaagcttgtctgctctatagaaatgaa

SEQ ID NO: 930 - DNA, 50 bp, Homo sapiens; identical to SEQ ID NO: 929

SEQ ID NO: 931 - DNA, 50 bp, Homo sapiens; identical to SEQ ID NO: 602

SEQ ID NO: 932 - DNA, 50 bp, Homo sapiens
ccccttcaactgagggtcattttaccagagtcaataaaggccaacccttc

SEQ ID NO: 933 - DNA, 50 bp, Homo sapiens
attctgagggtgactgaggctacagctgctatcacatgccgaactttctt

SEQ ID NO: 934 - DNA, 50 bp, Homo sapiens
tggtatcaggagttgggatttctcagcactgctaatgaagatcccctctt

SEQ ID NO: 935 - DNA, 50 bp, Homo sapiens
cgcagagaggagaaaaggagacagcaagacgccaataaagaaacacaact

SEQ ID NO: 936 - DNA, 50 bp, Homo sapiens
cccgcacgggcagctgaaggccgctgttttctaatatttgtattctaatt

SEQ ID NO: 937 - DNA, 50 bp, Homo sapiens
cccctgggagatgtagcaaattgagtgtgggttttggagtctgagcctca

SEQ ID NO: 938 - DNA, 50 bp, Homo sapiens
gcagagggagggttgccatgaaggaacttgggattttcaatggaataaat

SEQ ID NO: 939 - DNA, 50 bp, Homo sapiens
cctttcacgtctggacgaattaccaaatgccatgaattgccactgtgtgt

SEQ ID NO: 940 - DNA, 50 bp, Homo sapiens
aggaagatggcgctgttatcagcggggaaatgtactatttaagatcagct

SEQ ID NO: 941 - DNA, 50 bp, Homo sapiens
atccaagtctgaaactctgcgctctagtactgctgttaagatacacaact

SEQ ID NO: 942 - DNA, 50 bp, Homo sapiens
tggatagccatttctgctcaaccacacattctctaagaaacagcttgaaa

SEQ ID NO: 943 - DNA, 50 bp, Homo sapiens
tgttgtatgtggatggggaagttttgtttctcctcttagcatttgtttct

SEQ ID NO: 944 - DNA, 50 bp, Homo sapiens
tctgaatgatcctactcctttggagtaaaactagtgcttaccagtttcca

SEQ ID NO: 945 - DNA, 50 bp, Homo sapiens
tccttttgtagccactttgagtctgcagttgtcagtaagcctttttaaag

SEQ ID NO: 946 - DNA, 50 bp, Homo sapiens
gggggaaattaccagtagaatgccttggtctgaatatttgatagaaccaa

SEQ ID NO: 947 - DNA, 50 bp, Homo sapiens
ctggtactttacagttttgcaccaactctgccaagccactggatcttaca

SEQ ID NO: 948 - DNA, 50 bp, Homo sapiens
atccagtcactcatcaagtgtaatctgtctcctaaatatctctggaacct

SEQ ID NO: 949 - DNA, 50 bp, Homo sapiens
agcttttggggtcagatctctggaacatcatgtgatgaagctgacatttt

SEQ ID NO: 950 - DNA, 50 bp, Homo sapiens
agcagttaggcttgactttgaggagaggctgtgatgtttatgatccctga

SEQ ID NO: 951 - DNA, 50 bp, Homo sapiens
gctgtccacagaaaacgcccttaagtagccctaccttactccttagagct

SEQ ID NO: 952 - DNA, 50 bp, Homo sapiens
catgggtattaatagtctttgctgctggtaatactgaaagaacctgcttt

SEQ ID NO: 953 - DNA, 50 bp, Homo sapiens
aggatttgatttcttgaaaccctctaggtctctagaacactgaggacagt

SEQ ID NO: 954 - DNA, 50 bp, Homo sapiens
ggactcaggagctaatactgtctacagtggagcttggtgcaattagaagc

SEQ ID NO: 955 - DNA, 50 bp, Homo sapiens
accaggaggacagagtttgctttcatattttccctgtaagtaagagggct

SEQ ID NO: 956 - DNA, 50 bp, Homo sapiens
ccatgaagaagcaagacgaaaacacacaggagggaaaatcctgggattct

SEQ ID NO: 957 - DNA, 50 bp, Homo sapiens
ttggaatttgtgttgcatgtaaggcaatctttcctgttgtaaatcttcct

SEQ ID NO: 958 - DNA, 50 bp, Homo sapiens
aggaaactgagtagactcctgtgtaaccctgtttggaactttgccttctt

SEQ ID NO: 959 - DNA, 50 bp, Homo sapiens
tttacaaggcagaatggggtgtaacagttgaattaaactagcaatcacgt

SEQ ID NO: 960 - DNA, 50 bp, Homo sapiens
tagtaggaatgaagtggaagtccaggcttggattgcctaactacactgct

SEQ ID NO: 961 - DNA, 50 bp, Homo sapiens
agtgtttagtctcatgttgggaacacatgaatgtgatgaacatagtgaat

SEQ ID NO: 962 - DNA, 50 bp, Homo sapiens
accctttgagagttccacaagtggtagtagagtggtttaacgtctttcct

SEQ ID NO: 963 - DNA, 50 bp, Homo sapiens
ttgccccttttctgtaagtctcttgggatcctgtgtagaagctgttctca

SEQ ID NO: 964 - DNA, 50 bp, Homo sapiens
actcatcaattgaaaagtcctccaaaaagagaactattgggaaaccatgg

SEQ ID NO: 965 - DNA, 50 bp, Homo sapiens; identical to SEQ ID NO: 21

SEQ ID NO: 966 - DNA, 50 bp, Homo sapiens
tcagacctggttgattttgtactttggaactgtaccttggatggttttgt

SEQ ID NO: 967 - DNA, 50 bp, Homo sapiens
gtatctcatggcctcttgatgtggaaagaagttgacagagggttgcaggg

SEQ ID NO: 968 - DNA, 50 bp, Homo sapiens
agttcagtgagaagaaaccagaacacttgttcctagtgttgtgttgtttt

SEQ ID NO: 969 - DNA, 50 bp, Homo sapiens
gcagatggctatgtgctagagggcaaagagttggagttctatcttaggaa

SEQ ID NO: 970 - DNA, 50 bp, Homo sapiens
ttggtgtcaatgatctggtgacaataggattacattggagccaattgaat

SEQ ID NO: 971 - DNA, 50 bp, Homo sapiens
aactagaagatgtacttcgacagcatccattttacttcaaggcagcaaga

SEQ ID NO: 972 - DNA, 50 bp, Homo sapiens
atacacttttccaaatttgtcccaacagccctgtaagccagctttcttct

SEQ ID NO: 973 - DNA, 50 bp, Homo sapiens
gcattttcttcacttgcaggcaaacttggctctcaataaacttttaccac

SEQ ID NO: 974 - DNA, 50 bp, Homo sapiens; identical to SEQ ID NO: 129

SEQ ID NO: 975 - DNA, 50 bp, Homo sapiens
agccaaatgtgtcatacatcaaatcttcagcagcttttgcataatccagg

SEQ ID NO: 976 - DNA, 50 bp, Homo sapiens
tcctcaaaggggaaaactatgaaggggaagaagacaaacctaagatacca

SEQ ID NO: 977 - DNA, 50 bp, Homo sapiens
agatggactggagctttttctttgtgaatagaaactggatgccacagtga

SEQ ID NO: 978 - DNA, 50 bp, Homo sapiens
agttgtcagaagactcctgggtgtacagagcaaatcaagctgcatcagta

SEQ ID NO: 979 - DNA, 50 bp, Homo sapiens
agtggcttcatagctactgacaaatgtctgaactattgtcgtgcccttca

SEQ ID NO: 980 - DNA, 50 bp, Homo sapiens
gcctgtacaaacattcaagttagttggcagtctataaatgtgagttgggt

SEQ ID NO: 981 - DNA, 50 bp, Homo sapiens
aaggaaggtaaagttaggggactagaagactctaaattggcttctacaga

SEQ ID NO: 982 - DNA, 50 bp, Homo sapiens
agaactaattgcccatgtttaattatagcagacacgccattctaacaggt

SEQ ID NO: 983 - DNA, 50 bp, Homo sapiens
aacttggtattgttgtagtttatgtagtaagtgacttggcacccatcaga

SEQ ID NO: 984 - DNA, 50 bp, Homo sapiens
agtttaacttttcctcacccctgtatagaaaatgccttgcctctcaagag

SEQ ID NO: 985 - DNA, 50 bp, Homo sapiens
gtcttgggctggatgggttatagagctgagcggctgtgatggttctgttt

SEQ ID NO: 986 - DNA, 50 bp, Homo sapiens
gacacatctagaatgtttttctttcaccgtacctccaaaagaggcaattt

SEQ ID NO: 987 - DNA, 50 bp, Homo sapiens
accagggatgctctctaacgtaatcaagggaaggttcagtaagacaaagt

SEQ ID NO: 988 - DNA, 50 bp, Homo sapiens
acacagttcagtttttgagggaactagttttgtcataatactacacccct

SEQ ID NO: 989 - DNA, 50 bp, Homo sapiens
tgcagtgggaattcttgagtgaggtcttacctcttctttaaacctcttca

SEQ ID NO: 990 - DNA, 50 bp, Homo sapiens
aaggcagaatagaatgctgagattggttaagtttgcaatgaccatcttga

SEQ ID NO: 991 - DNA, 50 bp, Homo sapiens
tgccctaatcttgagttgaggaaatatatgcacaggagtcaaagagatgt

SEQ ID NO: 992 - DNA, 50 bp, Homo sapiens
gctagattgtgaagtacatgggatttcatgagccagaggaggcatttgga

SEQ ID NO: 993 - DNA, 50 bp, Homo sapiens
gcctcaaagaaaacccagagtgccctgttctaaaacgtagttctgaatcc

SEQ ID NO: 994 - DNA, 50 bp, Homo sapiens
aatcccagggcttggttaagtgctgtgtgataacttgtttggatgagact

SEQ ID NO: 995 - DNA, 50 bp, Homo sapiens
aggtttcttacccaacacaaatggacagtggatttgactttctaaagact

SEQ ID NO: 996 - DNA, 50 bp, Homo sapiens
cctggtgatgggaagggtcttgtgttttaatgccaataaatgtgccagct

SEQ ID NO: 997 - DNA, 50 bp, Homo sapiens
aaaatattgagccaggccctggggaagtgggaagtgagagccagagcggc

SEQ ID NO: 998 - DNA, 50 bp, Homo sapiens
agcacacaaggaatcccagaaaatgttggctgaaggaataaatggatgga

SEQ ID NO: 999 - DNA, 50 bp, Homo sapiens
cactgcctaccgccattcatgattaaaccatccagaaataccatccctgt

SEQ ID NO: 1000 - DNA, 50 bp, Homo sapiens
aaatgagatggcctctgcggacacatgaaagggtacttcagcttaccaaa

SEQ ID NO: 1001 - DNA, 50 bp, Homo sapiens
tggactaggagagacttgattttggtgctaaagttccccagttcatatgt

SEQ ID NO: 1002 - DNA, 50 bp, Homo sapiens
ctcacagccagcacgacccccagaaagaggcgtcccacaataaacacgtc

SEQ ID NO: 1003 - DNA, 50 bp, Homo sapiens
acagaacattgagatgtgcctagttccgtatttacagtttggtctggctg

SEQ ID NO: 1004 - DNA, 50 bp, Homo sapiens
tgaatttcagatgggtgatttaagtgagtcacaagtcacaaaactttgct

SEQ ID NO: 1005 - DNA, 50 bp, Homo sapiens
tgtacttaagtgctgatgactgttagccagtttacaactttttaccatcg

SEQ ID NO: 1006 - DNA, 50 bp, Homo sapiens
ttctgaacattttagtcaagctacaacaggtttggaaaacctctgtgggg

SEQ ID NO: 1007 - DNA, 50 bp, Homo sapiens
tgtcaagggcattaaaagcctcctgaagcataatcttatcaaagggatac

SEQ ID NO: 1008 - DNA, 50 bp, Homo sapiens
tcagtccatctcaagacctgtgcctgtcagatttcacaattatggagatt

SEQ ID NO: 1009 - DNA, 50 bp, Homo sapiens
ggtaggagtgaaatctctctctcaaactctaggaaagcccgagtcatact

SEQ ID NO: 1010 - DNA, 50 bp, Homo sapiens
acagcaggtgtcatgggtcaagcataaatcatatatagcattttcaggca

SEQ ID NO: 1011 - DNA, 50 bp, Homo sapiens; identical to SEQ ID NO: 1010

SEQ ID NO: 1012 - DNA, 50 bp, Homo sapiens
tgtgggtccctatgagtgtagagcccatatccccatagagtctacctaga

SEQ ID NO: 1013 - DNA, 50 bp, Homo sapiens
tgttttcatttcagaacattgtgctgtctgtcagcatatgtatatcagct

SEQ ID NO: 1014 - DNA, 50 bp, Homo sapiens
tggctactgcaaaaccagttttgacaggtcagattttcatatgtataggt

SEQ ID NO: 1015 - DNA, 50 bp, Homo sapiens
agaggttctgaaaggtctgtgtcttgtcaaaacaagtaaacggtggaact

SEQ ID NO: 1016 - DNA, 50 bp, Homo sapiens
atgcgtcctggttttcaatcgctgctgaacaaacctatcaaaaatgtagc

SEQ ID NO: 1017 - DNA, 50 bp, Homo sapiens
agtatgatccctcaaaacctcactaactggaaggatgattttgtctcagt

SEQ ID NO: 1018 - DNA, 50 bp, Homo sapiens
gagggttcctcactgaggttgagaggtgtgttggataggactgatcccac

SEQ ID NO: 1019 - DNA, 50 bp, Homo sapiens
aagtgtggttcctgaaggctgtctttgtaactttttgtagttctttgtgt

SEQ ID NO: 1020 - DNA, 50 bp, Homo sapiens; identical to SEQ ID NO: 798

SEQ ID NO: 1021 - DNA, 50 bp, Homo sapiens
ctggaaagggggctaagatcagggccttcattctggatcaggcgaaattt

SEQ ID NO: 1022 - DNA, 50 bp, Homo sapiens
gttcctcttcgggaagcttttgataaggaattctcagaccgatagggtgt

SEQ ID NO: 1023 - DNA, 50 bp, Homo sapiens
agttttgtacttttcacatagcttgttgccccgtaaaagggttaacagca

SEQ ID NO: 1024 - DNA, 50 bp, Homo sapiens
ttggatctggttctgaggaggacacacctggcatcggatgacctttataa

SEQ ID NO: 1025 - DNA, 50 bp, Homo sapiens
tagacatgcttgtgtccacacagcacaccaatgtgatacttccactgacc

SEQ ID NO: 1026 - DNA, 50 bp, Homo sapiens
atgggatgcggtgggttgcccaataaacggctgtggagtggaaattcctc

SEQ ID NO: 1027 - DNA, 50 bp, Homo sapiens
tttgtacgtagctgttacatgtagggcaatctgtctttaagtagggataa

SEQ ID NO: 1028 - DNA, 50 bp, Homo sapiens; identical to SEQ ID NO: 38

SEQ ID NO: 1029 - DNA, 50 bp, Homo sapiens
gagatgagttttgttattttggggttttcaagcattggaaccaaaggcca

SEQ ID NO: 1030 - DNA, 50 bp, Homo sapiens
tcacttagacccctgtaacaggttaaatcttcatggtgttctgtttccta

SEQ ID NO: 1031 - DNA, 50 bp, Homo sapiens
gctctccagactgttacagtgcatgagtgataataaaaatgagtcagtca

SEQ ID NO: 1032 - DNA, 50 bp, Homo sapiens
ggaggtaaacattggagatgtttgtgaaaatattactcttgctgtgaggt

SEQ ID NO: 1033 - DNA, 50 bp, Homo sapiens
ggcccctttctttcttctgaggattgcagaggatatagttatcaatctct

SEQ ID NO: 1034 - DNA, 50 bp, Homo sapiens
tcaacagcacttaaactgaagtttgggttgctcatacaataaacagattg

SEQ ID NO: 1035 - DNA, 50 bp, Homo sapiens
gggccattttatgatgcattgcacaccctctggggaaattgatctttaaa

SEQ ID NO: 1036 - DNA, 50 bp, Homo sapiens
ttttccacaggggacctacccctattgcggtcctccagctcatctttcac

SEQ ID NO: 1037 - DNA, 50 bp, Homo sapiens
gggtgagaacacttgcaacagtttattaatgaggtgactttcaccttagg

SEQ ID NO: 1038 - DNA, 50 bp, Homo sapiens
aatgtaccatcaataaaattggctgcttgggcagttttagttaccacctt

SEQ ID NO: 1039 - DNA, 50 bp, Homo sapiens
ttttcagaggcttcctaattaatcttgccctcctccatttcagtccattt

SEQ ID NO: 1040 - DNA, 50 bp, Homo sapiens
agctccaaccttacgatggagaattaaacttgcttgtatttccactttgt

SEQ ID NO: 1041 - DNA, 50 bp, Homo sapiens
agcttcctcttcctcaggacagcttctactttagatgatccaataatgat

SEQ ID NO: 1042 - DNA, 50 bp, Homo sapiens
cactgacttctattccatgagctttttcaaggcgcttattttatggcagc

SEQ ID NO: 1043 - DNA, 50 bp, Homo sapiens
tgtttcgtaaattaaataggtctggcccagaagacccactcaattgcctt

SEQ ID NO: 1044 - DNA, 50 bp, Homo sapiens
ggaagacccaaggaaatccggaatttcgcaccagaggacccaccacgtcc

SEQ ID NO: 1045 - DNA, 50 bp, Homo sapiens
tcttgttacttccaaggagaaccaagaatggctctgtcacactcgaagcc

SEQ ID NO: 1046 - DNA, 50 bp, Homo sapiens
tctttctctaaagcttgtttgatgaaactggttggtcctttcagtgaaca

SEQ ID NO: 1047 - DNA, 50 bp, Homo sapiens
gctgtgtgacttagtagataaaatactgccttctgcctttgggaccatga

SEQ ID NO: 1048 - DNA, 50 bp, Homo sapiens
tctgtaattggacagctctctcgaagagatcttacagactgtatcagtct

SEQ ID NO: 1049 - DNA, 50 bp, Homo sapiens
ggtcgtggacgtggtcagccacctcagtaaaattggagaggattcttttg

SEQ ID NO: 1050 - DNA, 50 bp, Homo sapiens
aaagtgaaaccaagagtacaagagacaggtgaaattaaagagccccttga

SEQ ID NO: 1051 - DNA, 50 bp, Homo sapiens
gtccaggatgcagagctaaaggccctcctccagagttctacaagtcgaaa

SEQ ID NO: 1052 - DNA, 50 bp, Homo sapiens
ccaacttgagatgtatgaaggcttttggtctccctgggagtgggtggagg

SEQ ID NO: 1053 - DNA, 50 bp, Homo sapiens
ttcctcatcccatttacagtttttctaactccagggtagtgtttagtgtt

SEQ ID NO: 1054 - DNA, 50 bp, Homo sapiens
catgccaaagactcaactgctttcaaagataatgtgggtgctagatgcag

SEQ ID NO: 1055 - DNA, 50 bp, Homo sapiens
tccccttctcccctgcactgtaaaatgtgggattatgggtcacaggaaaa

SEQ ID NO: 1056 - DNA, 50 bp, Homo sapiens
accatgcatagagtcaatcaaatccttgtgatgttttgtatggactttga

SEQ ID NO: 1057 - DNA, 50 bp, Homo sapiens
tgtgctgcctcaagactgctggagtcaggacattttatagagccttttcc

SEQ ID NO: 1058 - DNA, 50 bp, Homo sapiens
gtgcagtctcttagcagacttcaggcccaaactgtattcttcactcaggc

SEQ ID NO: 1059 - DNA, 50 bp, Homo sapiens
gttagtgaaagctgtttactgtaacggggaaaaccagattctttgcatct

SEQ ID NO: 1060 - DNA, 50 bp, Homo sapiens
gcttctgtaaatgccatcccaatgtggtttggttttgttgaacagaaacc

SEQ ID NO: 1061 - DNA, 50 bp, Homo sapiens
ttgcctcgataagtttccaagtcactgaaatctgctgaaggttttactgt

SEQ ID NO: 1062 - DNA, 50 bp, Homo sapiens
acttctgaactgaggaatttgctgttgacagccaaagtatagtgtacaag

SEQ ID NO: 1063 - DNA, 50 bp, Homo sapiens
agagccatctggtgtgaagaactctatatttgtatgttgagagggcatgg

SEQ ID NO: 1064 - DNA, 50 bp, Homo sapiens
agaacaagtttgccttgattttgtttaaaatgacttctgctaagcaccca

SEQ ID NO: 1065 - DNA, 50 bp, Homo sapiens
cctgccaaagcaagaagaaggcttggtccccagaaacaaacagtagtcat

SEQ ID NO: 1066 - DNA, 50 bp, Homo sapiens
ggagtctcaggccaaggatgtcattgaagagtatttcaaatgcaagaaat

SEQ ID NO: 1067 - DNA, 50 bp, Homo sapiens; identical to SEQ ID NO: 1066

SEQ ID NO: 1068 - DNA, 50 bp, Homo sapiens
tttcatctgaatccagaggtgcatcaaattaaatgacagctccacttggc

SEQ ID NO: 1069 - DNA, 50 bp, Homo sapiens
ttgacacgttccacttcctttgcaattattgtatttagttgtgcactagt

SEQ ID NO: 1070 - DNA, 50 bp, Homo sapiens
ccaaatcaactgtgtgaactgtttctgcactgcttgctaatggtttcatc

SEQ ID NO: 1071 - DNA, 50 bp, Homo sapiens
attgagacgggaaaaactcgctgtaaaataatgccaacctagataatgct

SEQ ID NO: 1072 - DNA, 50 bp, Homo sapiens
tgttcttgcattgcatttaatgatcccttttctccccacctccacacact

SEQ ID NO: 1073 - DNA, 50 bp, Homo sapiens
tgcagattcctagtagcatgccttacctacagcactatgtgcatttgctg

SEQ ID NO: 1074 - DNA, 50 bp, Homo sapiens
gcaagaccgtttgtccacttcattttgtataatcacagttgtgttcctga

SEQ ID NO: 1075 - DNA, 50 bp, Homo sapiens
aatttaacttttgggtgccaggaaatgggttttctcaaagtccattgccg

SEQ ID NO: 1076 - DNA, 50 bp, Homo sapiens
tcgtggaagggagagccatcagcagaaagagaccctgagatcttcgcctg

SEQ ID NO: 1077 - DNA, 50 bp, Homo sapiens
aaacacaccagggagacaccataaaacagaccaagactaacttaaaaaca

SEQ ID NO: 1078 - DNA, 50 bp, Homo sapiens
aaccacaatcaaacatataaataagcctggaaaaccaactacaaccagca

SEQ ID NO: 1079 - DNA, 50 bp, Homo sapiens
tttcctgattatttgatgctagctggaattcaagaaatggcattgacctt

SEQ ID NO: 1080 - DNA, 50 bp, Homo sapiens
tcaccccaagtagcatgactgatctgcaatttaaaattcctgtgatctgt

SEQ ID NO: 1081 - DNA, 50 bp, Homo sapiens
tgagaagtgcggaataggttgcttctaccacctgttcttaatgtaacagt

SEQ ID NO: 1082 - DNA, 50 bp, Homo sapiens
tcgaatgagtggtcaggtagtcttaaagagcctcatgttaaatagacaca

SEQ ID NO: 1083 - DNA, 50 bp, Homo sapiens
tgaagtgcaaataaaagcactgctactataagacattctggaatggttgt

SEQ ID NO: 1084 - DNA, 50 bp, Homo sapiens
gcagtccccagatccagaacatgggaagttagggaaaatgtgtgattttg

SEQ ID NO: 1085 - DNA, 50 bp, Homo sapiens
aggtatgacaggaactgtcttcatgtccttacccaagcaagtcatccatg

SEQ ID NO: 1086 - DNA, 50 bp, Homo sapiens
aattttgaatttctccttgccacgttaataaagccaaaagcagcgggtgc

SEQ ID NO: 1087 - DNA, 50 bp, Homo sapiens
tgactctgtgctggcaaaaatgcttgaaacctctatatttctttcgttca

SEQ ID NO: 1088 - DNA, 50 bp, Homo sapiens
gctctcccacagaaacctttgtccttgcaactttatcctttgtcccgatt

SEQ ID NO: 1089 - DNA, 50 bp, Homo sapiens
ttgccttagccagtgtacctcctacctcagtctatgtgagaggaagagaa

SEQ ID NO: 1090 - DNA, 50 bp, Homo sapiens
actgtattgggattgtaaagaacatctctgcactcagacagtttacagaa

SEQ ID NO: 1091 - DNA, 50 bp, Homo sapiens
gtgtgtgtgcatgtgtgtgttagcagaggtattttactcagaaaataggt

SEQ ID NO: 1092 - DNA, 50 bp, Homo sapiens
gccagtcaaaaagtaaaatgaagagaggcacgccaaccactccaaaattt

SEQ ID NO: 1093 - DNA, 50 bp, Homo sapiens
cactttgtggtcgaaaggctcagcctctctacatgaagtctgtggacatg

SEQ ID NO: 1094 - DNA, 50 bp, Homo sapiens
aggctttcttgtctcagcaactttcccatcttgtctctcttggatgatgt

SEQ ID NO: 1095 - DNA, 50 bp, Homo sapiens
tttttctttttgaagcatggaaaacaaatcttttatgccactccagccat

SEQ ID NO: 1096 - DNA, 50 bp, Homo sapiens
ccatgatataaggaagggccgtgcctcatggaaaagcaacaggtggcctc

SEQ ID NO: 1097 - DNA, 50 bp, Homo sapiens
taaaggcgagcaccgtcaggagcgcagagatcggccctactagatgcaga

SEQ ID NO: 1098 - DNA, 50 bp, Homo sapiens
tgagcctgacacctgtgtttcagcatttggagacatccccatgttattct

SEQ ID NO: 1099 - DNA, 50 bp, Homo sapiens
ctgagccacatccaagcctggtttgctgcactctattgccaaagactgac

SEQ ID NO: 1100 - DNA, 50 bp, Homo sapiens
acttgcctcattctcatcatccaaactgaacatttgtatcccaagcagaa

SEQ ID NO: 1101 - DNA, 50 bp, Homo sapiens
gtatgaagaaggaagcccagcagagcaggaggcagcagcaacaatgagag

SEQ ID NO: 1102 - DNA, 50 bp, Homo sapiens
ctgtgtgtgtccatgtctgcaagcagttcttcaataaatggcctgcctcc

SEQ ID NO: 1103 - DNA, 50 bp, Homo sapiens
tcaaagcagagcacagagttatttggtgtttgctgaagacagcctttgtg

SEQ ID NO: 1104 - DNA, 50 bp, Homo sapiens
acttccatctcagctaatgcacccaccagctcaaacacaccaataaagct

SEQ ID NO: 1105 - DNA, 50 bp, Homo sapiens
tgcaatccacaatctgacattctcaggaagcccccaagttgatatttcta

SEQ ID NO: 1106 - DNA, 50 bp, Homo sapiens
cagaaaccaatactgctgtgcactgagaataaaaactcatgcccccttgt

SEQ ID NO: 1107 - DNA, 50 bp, Homo sapiens
caccagtgaggattactgatgtggacagttgatggggtttgtttctgtat

SEQ ID NO: 1108 - DNA, 50 bp, Homo sapiens; identical to SEQ ID NO: 500

SEQ ID NO: 1109 - DNA, 50 bp, Homo sapiens
taaggggtagacaagataccgaataatctccacaagtttatttgtggtct

SEQ ID NO: 1110 - DNA, 50 bp, Homo sapiens
acatcaacagtggtgctgtggaatgcccagccagttaagcacaaaggaaa

SEQ ID NO: 1111 - DNA, 50 bp, Homo sapiens
acaaacaatgcaaccaactatccaagtgttataccaactaaaacccccaa

SEQ ID NO: 1112 - DNA, 50 bp, Homo sapiens
ttcacctacaaaatttcacctgcaaaccttaaacctgcaaaattttcctt

SEQ ID NO: 1113 - DNA, 50 bp, Homo sapiens
gggtacttctccataaggcatctcagtcaaatccccatcactgtcataaa

SEQ ID NO: 1114 - DNA, 50 bp, Homo sapiens
cttgctgttttccctgtccacatccatgctgtacagacaccaccattgaa

SEQ ID NO: 1115 - DNA, 50 bp, Homo sapiens
aagtcaattcctggaatttgaaagagcaaataaagacctgagaaccttcc

SEQ ID NO: 1116 - DNA, 50 bp, Homo sapiens
aagctactgtgtgtgtgaatgaacactcttgctttattccagaatgctgt

SEQ ID NO: 1117 - DNA, 50 bp, Homo sapiens
tgtcatgctcccagaatttcagcttcagcttaactgacagatgttaaagc

SEQ ID NO: 1118 - DNA, 50 bp, Homo sapiens
aggtggtactcaagccatgctgcctccttacatcctttttggaacagagc

SEQ ID NO: 1119 - DNA, 50 bp, Homo sapiens; identical to SEQ ID NO: 75

SEQ ID NO: 1120 - DNA, 50 bp, Homo sapiens
tgtggttaggaagcaatttcccaatgtacctataagaaatgtgcatcaag

SEQ ID NO: 1121 - DNA, 50 bp, Homo sapiens
gcctgcgttgccacttgtcttaactctgaatatttcatttcaaaggtgct

SEQ ID NO: 1122 - DNA, 50 bp, Homo sapiens
agctaatattgctgcaatggctggcaggaaacaggtgatcaagagtgtca

SEQ ID NO: 1123 - DNA, 50 bp, Homo sapiens
tcgaccccagaggtgaatgtattgttattattgttttgttgttgttgtga

SEQ ID NO: 1124 - DNA, 50 bp, Homo sapiens
tccttggcagctgtattctggagtctggatgttgctctctaaagaccttt

SEQ ID NO: 1125 - DNA, 50 bp, Homo sapiens
tttgccatgtccagtacagaataatttgtacttagtatttgcagcagggt

SEQ ID NO: 1126 - DNA, 50 bp, Homo sapiens
tagagaacctatagcatcttctcattcccatgtggaacaggatgcccaca

SEQ ID NO: 1127 - DNA, 50 bp, Homo sapiens
aactcatgtgcaggtttgataaacaccagaacagaagacagtgatgctgt

SEQ ID NO: 1128 - DNA, 50 bp, Homo sapiens
tggccctgacagtattcattatttcagataattccctgtgataggacaac

SEQ ID NO: 1129 - DNA, 50 bp, Homo sapiens
acctggagagagaaggtattgaaacatctcctttatgtgtgactttccca

SEQ ID NO: 1130 - DNA, 50 bp, Homo sapiens
agaaatacccactaacaaagaacaagcattagttttggctgtcatcaact

SEQ ID NO: 1131 - DNA, 50 bp, Homo sapiens
atgggcaaattcttaggtaagacaaaaacacagccccaagggcaggtagt

SEQ ID NO: 1132 - DNA, 50 bp, Homo sapiens
gctgatgccactacccgatttgtttatttgcaatttgagccatttaaaga

SEQ ID NO: 1133 - DNA, 50 bp, Homo sapiens
cctgttcccttcagccaacccgtttctgcagtaaaattaagcctgtcaaa

SEQ ID NO: 1134 - DNA, 50 bp, Homo sapiens
tggcttaaaccagtgttcagtctggtgccaaacttcgaatggaatacaaa

SEQ ID NO: 1135 - DNA, 50 bp, Homo sapiens
tgtgagttgtgaccatgtaacatgagaggttttgctagggcctattattt

SEQ ID NO: 1136 - DNA, 50 bp, Homo sapiens
agctgagtaattctaatctcttctgtgttttccttgccttaaccacaaat

SEQ ID NO: 1137 - DNA, 50 bp, Homo sapiens
aatttgctagaatccagtaaatcattttggtagctctggctgtgctatca

SEQ ID NO: 1138 - DNA, 50 bp, Homo sapiens
tggctcgaagtttctctagtgttttctgtggaaggaataaaaatttgagt

SEQ ID NO: 1139 - DNA, 50 bp, Homo sapiens
actcttgggagtgctgcagtctttaatcatgctgtttaaactgttgtggc

SEQ ID NO: 1140 - DNA, 50 bp, Homo sapiens
tttacatgattggaccctcagattctgttaaccaaaattgcagaatgggg

SEQ ID NO: 1141 - DNA, 50 bp, Homo sapiens
tgaaatcaaagcacggtgcagaacttgtaccaagtacaaaaggtccatgt

SEQ ID NO: 1142 - DNA, 50 bp, Homo sapiens
ccttactctgtccttgatggaggggagaagggagggcaaagaagttaaat

SEQ ID NO: 1143 - DNA, 50 bp, Homo sapiens
caccgccatgcaactccatgcctatttactggaaacctgttatgccaaac

SEQ ID NO: 1144 - DNA, 50 bp, Homo sapiens
caagagaatgaaggaggctaaggagaagcgccaggaacaaattgcgaaga

SEQ ID NO: 1145 - DNA, 50 bp, Homo sapiens
agtctcgggtatgctgttgtgaaattgaaactgtaaaagtagatggttga

SEQ ID NO: 1146 - DNA, 50 bp, Homo sapiens
actaaactacccgaaggacttaggtgctttgtgtacttaaccccaggacc

SEQ ID NO: 1147 - DNA, 50 bp, Homo sapiens
gccaccactgtctgtttgagactccttcatgagcaaagattgatgtatgg

SEQ ID NO: 1148 - DNA, 50 bp, Homo sapiens
atgaatttgaagacatggtggctgaaaagcggctcatcccagatggttgt

SEQ ID NO: 1149 - DNA, 50 bp, Homo sapiens
agcttcagtctctactggattagccctactctttcctttcccctccatta

SEQ ID NO: 1150 - DNA, 50 bp, Homo sapiens
agatgtggttatcacaagtctcgagggggaaactactgcataaaataact

SEQ ID NO: 1151 - DNA, 50 bp, Homo sapiens
tcagtaaaaatgcctgttgtgagatgaacctcctgtaacttctatctgtt

SEQ ID NO: 1152 - DNA, 50 bp, Homo sapiens
agttaactgcggagccaagagttggactataattaaattaccttccttgt

SEQ ID NO: 1153 - DNA, 50 bp, Homo sapiens
ccggtttgggttgttaatggttgaaaacttagaggaacatagtgaggcct

SEQ ID NO: 1154 - DNA, 50 bp, Homo sapiens; identical to SEQ ID NO: 1153

SEQ ID NO: 1155 - DNA, 50 bp, Homo sapiens
ccagtgatttgattaactcagggcaaggctgaatatcagagtgtatcgca

SEQ ID NO: 1156 - DNA, 50 bp, Homo sapiens; identical to SEQ ID NO: 386

SEQ ID NO: 1157 - DNA, 50 bp, Homo sapiens
actggacatcgccctacgcaacctcctcgccatgactgataagttccttt

SEQ ID NO: 1158 - DNA, 50 bp, Homo sapiens
actgctggtagcatttatctgacttggaaagttggagaagaggcattcct

SEQ ID NO: 1159 - DNA, 50 bp, Homo sapiens
cttccgaagagaagaggctggggctgtaactggaaaggggaagcgcacag

SEQ ID NO: 1160 - DNA, 50 bp, Homo sapiens
cctgaccttgagctctagtctcccctttaaatcttaccttggcagtaaca

SEQ ID NO: 1161 - DNA, 50 bp, Homo sapiens
ttggtcccacagtttttatgtgtcctacttgaaattatgtttgctcccgt

SEQ ID NO: 1162 - DNA, 50 bp, Homo sapiens
tggaggatttttgttaagtcaagtgtcaatcgaagttaaaaagcaagggt

SEQ ID NO: 1163 - DNA, 50 bp, Homo sapiens
atggctcttttcctattagagcaacttgtgtttccctgataatgtgtaca

SEQ ID NO: 1164 - DNA, 50 bp, Homo sapiens
gtcgtgactgacttggtgtgttgctattgtgtttctatatactccgtcca

SEQ ID NO: 1165 - DNA, 50 bp, Homo sapiens
tttagtccagtggtttccacagctggctaagccaggagtcacttggaggc

SEQ ID NO: 1166 - DNA, 50 bp, Homo sapiens
tggaagacagtaaagaacagccctctgtagtcagtaaagtttcaccttct

SEQ ID NO: 1167 - DNA, 50 bp, Homo sapiens
tgggtggagtattatgtttaactggagttgtcaagtatgagtccctcagg

SEQ ID NO: 1168 - DNA, 50 bp, Homo sapiens
aaagtagtaaatcgggctgtcttaatagtgcgcctgttactaatggaatt

SEQ ID NO: 1169 - DNA, 50 bp, Homo sapiens
atgtcaagctttgggtctctggagtataactttttgtaacattagccatt

SEQ ID NO: 1170 - DNA, 50 bp, Homo sapiens
atctaggacacctccatcaaacctcctcttgcactttccctctggcttcc

SEQ ID NO: 1171 - DNA, 50 bp, Homo sapiens
tgtgatgggaacagtgtcttagggagatgcagcttggacttgaggtaaat

SEQ ID NO: 1172 - DNA, 50 bp, Homo sapiens
agaatgggaggccaaccttctatcagagttaaacttttgacaagggaaca

SEQ ID NO: 1173 - DNA, 50 bp, Homo sapiens
aaaaatgtgaaactgccctgcctcccctttttgctgacaacactgtgtac

SEQ ID NO: 1174 - DNA, 50 bp, Homo sapiens
ggccccattacaaaactccttaggaacctcgccctctctctgctgtaagg

SEQ ID NO: 1175 - DNA, 50 bp, Homo sapiens
gctgctgtctagatttatgtgtgctctgacaagaaatgttttgtgtaaca

SEQ ID NO: 1176 - DNA, 50 bp, Homo sapiens
ccaggctgcggtgagaatgccaagaaggcactacctcccacccacatcac

SEQ ID NO: 1177 - DNA, 50 bp, Homo sapiens
ccagttgtcttgaacagcctgactcctgccagccctatggaagttccttt

SEQ ID NO: 1178 - DNA, 50 bp, Homo sapiens; identical to SEQ ID NO: 1177

SEQ ID NO: 1179 - DNA, 50 bp, Homo sapiens
tctttaagaagaccaccacatagaataccccttcctatcagctcgctctg

SEQ ID NO: 1180 - DNA, 50 bp, Homo sapiens
tttgactttcaggatgtcatactacttctgtacctagcattttcagtcct

SEQ ID NO: 1181 - DNA, 50 bp, Homo sapiens
tgcttagatttgttcctgttgtcaaaactgttacccccaaaattggtgtg

SEQ ID NO: 1182 - DNA, 50 bp, Homo sapiens
aacaaggtacatgcattatgtgtcacattactgggcaaactgttcaagta

SEQ ID NO: 1183 - DNA, 50 bp, Homo sapiens
agcacaagcagtgtctgtcactttccatgcataaagtttagtgagatgtt

SEQ ID NO: 1184 - DNA, 50 bp, Homo sapiens
agtgactaaatactgggaacctattttctcaatcttcctccatgttgtgt

SEQ ID NO: 1185 - DNA, 50 bp, Homo sapiens
cttcaggactgtatgagccgagcagttacaagacacaaagaagttaaaaa

SEQ ID NO: 1186 - DNA, 50 bp, Homo sapiens
agggccagatttcatgttgaccctggggatgctgtgaatttctcctgcag

SEQ ID NO: 1187 - DNA, 50 bp, Homo sapiens
aaatgcaggtttattatccagcactgagagagttaacaaggactggaaaa

SEQ ID NO: 1188 - DNA, 50 bp, Homo sapiens; identical to SEQ ID NO: 1187

SEQ ID NO: 1189 - DNA, 50 bp, Homo sapiens
ccctccttaatcaacttcaaggagcaccttcattagtacagcttgcatat

SEQ ID NO: 1190 - DNA, 50 bp, Homo sapiens
aaaccagtgactcctaatctttttcaagttaagacaccttaccattgctt

SEQ ID NO: 1191 - DNA, 50 bp, Homo sapiens
aagggaacacaaaactgtggtcctgacaatactaattctacccgttttca

SEQ ID NO: 1192 - DNA, 50 bp, Homo sapiens
tttttgtacgatcagccttactgctaataaaagcacttccacagggaaaa

SEQ ID NO: 1193 - DNA, 50 bp, Homo sapiens
aaattctacaaaggagaggttgggcgttacaaaggcattgtgaatctaat

SEQ ID NO: 1194 - DNA, 50 bp, Homo sapiens; identical to SEQ ID NO: 1193

SEQ ID NO: 1195 - DNA, 50 bp, Homo sapiens
ttcaccgaggacatgaaactccaccttgcggggataaagagagaaaaaca

SEQ ID NO: 1196 - DNA, 50 bp, Homo sapiens
tgtgctcttcagtagaggattttctgtgatcctacaatgaagggaaagct

SEQ ID NO: 1197 - DNA, 50 bp, Homo sapiens
tttgtgtaaaaccaccttttgaagcagcaactatcaagtctgaaaagcaa

SEQ ID NO: 1198 - DNA, 50 bp, Homo sapiens
agtgggtgaatcacagtaatttccctgtaaaatgtggtacctgaagtcat

SEQ ID NO: 1199 - DNA, 50 bp, Homo sapiens
taggctcatagccttgtatttcgttttagattgtaagctcaatggcaggg

SEQ ID NO: 1200 - DNA, 50 bp, Homo sapiens
gctcaagcaaatgtttggtaatgcagacatgaatacatttcccaccttca

SEQ ID NO: 1201 - DNA, 50 bp, Homo sapiens
aagtcatcatttgccttgaaagtttcctctgcattgggtttgaagtagtt

SEQ ID NO: 1202 - DNA, 50 bp, Homo sapiens
gagcaggggtgggagtggctgtaacttcacaatcctaatacagtaaatgt

SEQ ID NO: 1203 - DNA, 50 bp, Homo sapiens
ttcttaaggagtcttaactcggtacttgggttaacgccagaaattacttt

SEQ ID NO: 1204 - DNA, 50 bp, Homo sapiens
ttggtgagttgccaaagaagcaatacagcatatctgcttttgccttctgt

SEQ ID NO: 1205 - DNA, 50 bp, Homo sapiens
aggccttgtttttcagcttcatctgcagttctatgtgaagattgataaat

SEQ ID NO: 1206 - DNA, 50 bp, Homo sapiens
tgcaacttagaaaccagctacagtatggcccacttaataaaacacctgaa

SEQ ID NO: 1207 - DNA, 50 bp, Homo sapiens
agtttattgttagccaggttgcttgaaaggttgagagtggagtggtttgg

SEQ ID NO: 1208 - DNA, 50 bp, Homo sapiens
gcataactgctctagcttcttgtttaccatagtactgtggcttcagattt

SEQ ID NO: 1209 - DNA, 50 bp, Homo sapiens
tgtatcttttcctgttaaacacacagacccctccccaatctggacattga

SEQ ID NO: 1210 - DNA, 50 bp, Homo sapiens
gccttgccagcctgtgtgcttgtgggaacaccttgtacctgagcttacag

SEQ ID NO: 1211 - DNA, 50 bp, Homo sapiens
gcatgaatgggcaatattttcatctgtttacttgtagtgccatagaggcc

SEQ ID NO: 1212 - DNA, 50 bp, Homo sapiens
ggccttctatgtgcttagccataacaattccattaagcaagaaggtaagc

SEQ ID NO: 1213 - DNA, 50 bp, Homo sapiens
aattgaacaataaccattggtgactggagcaggtaattatagcctgcaga

SEQ ID NO: 1214 - DNA, 50 bp, Homo sapiens
aggggtcccaagagcctgtcctcttttgttcaaaatacatcttgaaacgt

SEQ ID NO: 1215 - DNA, 50 bp, Homo sapiens
cctgctgggactccctgacttactttggttggttcctagtgctacttgtt

SEQ ID NO: 1216 - DNA, 50 bp, Homo sapiens
ggaaagctcgtcagtttagtaggctccgaaatagaatagcagttgtcact

SEQ ID NO: 1217 - DNA, 50 bp, Homo sapiens
agaaggtaactttatagaagtaacaccaatatcctagtctgcttgccccg

SEQ ID NO: 1218 - DNA, 50 bp, Homo sapiens
gctgctccctggttccactctggagagtaatctgggacatcttagtgttt

SEQ ID NO: 1219 - DNA, 50 bp, Homo sapiens
ctctcctcttcccacctctgtatcccacacaggcatctggtgatgttctc

SEQ ID NO: 1220 - DNA, 50 bp, Homo sapiens
acacctgttctttgtaattgggttgtggtgcattttgcactacctggagt

SEQ ID NO: 1221 - DNA, 50 bp, Homo sapiens
agcctaggtgaaaatctatttataaatggaccacaactctggggtgtcgt

SEQ ID NO: 1222 - DNA, 50 bp, Homo sapiens
catgaagctctcaagtcctgcatcctgaggatccagatggatgacaagga

SEQ ID NO: 1223 - DNA, 50 bp, Homo sapiens
ggtggtgtttcctagaccttccctgatgcgattttacctttgttgaattt

SEQ ID NO: 1224 - DNA, 50 bp, Homo sapiens
acgatgctgtttgctctggaatgttcatcttttagacaggttttggctca

SEQ ID NO: 1225 - DNA, 50 bp, Homo sapiens
tccgagggatgagattaaggcagaggcaaaagtttcacacaaagtttctg

SEQ ID NO: 1226 - DNA, 50 bp, Homo sapiens
gccacaactcccatagatgccaatgttttgatagcctcagtttctcaacg

SEQ ID NO: 1227 - DNA, 50 bp, Homo sapiens
tgacccacccaccaaggaagaaagcagaataaacatttttgcactgcctg

SEQ ID NO: 1228 - DNA, 50 bp, Homo sapiens
catgctctcccatgacatctccatgctggtttctccatagcataaatgaa

SEQ ID NO: 1229 - DNA, 50 bp, Homo sapiens
ggtgccgtgcatcaccaaatgaaagtttgtatttaacgaggaggtgcttt

SEQ ID NO: 1230 - DNA, 50 bp, Homo sapiens
aaatcctctctgctgttcacattatcctttgtttaacgtatgaaccaggt

SEQ ID NO: 1231 - DNA, 50 bp, Homo sapiens
gtgtagaattcccggagcgtccgtggttcagagtaaacttgaagcagatc

SEQ ID NO: 1232 - DNA, 50 bp, Homo sapiens
tgggtaggttaagctgccatacgtgttcagtgtgaatagtgtttaagttg

SEQ ID NO: 1233 - DNA, 50 bp, Homo sapiens
tgatgcaagagtggacgtaatgctagttggcagtattttattgtaagaaa

SEQ ID NO: 1234 - DNA, 50 bp, Homo sapiens; identical to SEQ ID NO: 1151

SEQ ID NO: 1235 - DNA, 50 bp, Homo sapiens; identical to SEQ ID NO: 1035

SEQ ID NO: 1236 - DNA, 50 bp, Homo sapiens
aaaatgctgctggcttttctgaagacaggtgcttgaacttgtcagtttgt

SEQ ID NO: 1237 - DNA, 50 bp, Homo sapiens
ccgcccaaaagtctgttctgatggcactgagttttcattgttctggatgt

SEQ ID NO: 1238 - DNA, 50 bp, Homo sapiens
tggttgtgctaaattcatagcaggtgccttattctttgcttttagtcaaa

SEQ ID NO: 1239 - DNA, 50 bp, Homo sapiens
tttgccagggtaatcttcagttggccctgattcaattaaatggccttaat

SEQ ID NO: 1240 - DNA, 50 bp, Homo sapiens
acactccttaagttccaaatgttttccgctaatagtctgtcctaaagcct

SEQ ID NO: 1241 - DNA, 50 bp, Homo sapiens
aggactcttgaacatctgagcagttttgtgctttgagccactttttgaca

SEQ ID NO: 1242 - DNA, 50 bp, Homo sapiens
cgcctatatgaacctggacatatggactaccacagcgaataggaatgcaa

SEQ ID NO: 1243 - DNA, 50 bp, Homo sapiens; identical to SEQ ID NO: 1242

SEQ ID NO: 1244 - DNA, 50 bp, Homo sapiens
tttcctattttgctccagactatgttttcagcataccttgggtctgaaca

SEQ ID NO: 1245 - DNA, 50 bp, Homo sapiens
ttgtgctttctgtatttaaaactttggctgtactaagcaaatgcaaggtt

SEQ ID NO: 1246 - DNA, 50 bp, Homo sapiens
ggtcatcatagttgaggtatgtgtctgctatttgcaaagaagttggtcgt

SEQ ID NO: 1247 - DNA, 50 bp, Homo sapiens
ttcaggaccctagaggagagctttatacaattaccgatgtgaatttctct

SEQ ID NO: 1248 - DNA, 50 bp, Homo sapiens
tgttttgcttaatgtggacaatttacacacccaacacatactgtttccaa

SEQ ID NO: 1249 - DNA, 50 bp, Homo sapiens
gagatcaacgggatgaggtgttacagctgcctccctcttcatgcaatctg

SEQ ID NO: 1250 - DNA, 50 bp, Homo sapiens
aggtagggtttaatccccagtaaaattgccatattgcacatgtcttaatg

SEQ ID NO: 1251 - DNA, 50 bp, Homo sapiens
agggggtgatttttgctcttgtcctgagaaataacagtgctgttttaaaa

SEQ ID NO: 1252 - DNA, 50 bp, Homo sapiens
acttgagtggggttttccttttcccccaattctaagagaatataatgtgt

SEQ ID NO: 1253 - DNA, 50 bp, Homo sapiens
gcgtctgttgttagcaaagaatagattcacacagtctaaggtttccttcc

SEQ ID NO: 1254 - DNA, 50 bp, Homo sapiens
ccctcttagcctatccatcttaagccccaagctgagtgtggttctggtaa

SEQ ID NO: 1255 - DNA, 50 bp, Homo sapiens
taaggagaattagactcccaagtagacaccagagtcactgtttggttggt

SEQ ID NO: 1256 - DNA, 50 bp, Homo sapiens
acgtgtttttgggatatgtttccaatctttaaatgaccttgccctgtcca

SEQ ID NO: 1257 - DNA, 50 bp, Homo sapiens
aaccatttgttaactgtactgaaggtgtgtcctcaagaagaaagtgttca

SEQ ID NO: 1258 - DNA, 50 bp, Homo sapiens
aaacaaactgtgtaactgcccaaagcagcacttataaatcagcctaacat

SEQ ID NO: 1259 - DNA, 50 bp, Homo sapiens
aaactgatcacactgactggatctgtccacgacatggaaaataaactgga

SEQ ID NO: 1260 - DNA, 50 bp, Homo sapiens
ttgcattgatgaattttgtatctgcttccattaaaagcataacagccaca

SEQ ID NO: 1261 - DNA, 50 bp, Homo sapiens
atctctccttcagtctgctctgtttaattctgctgtctgctcttctctaa

SEQ ID NO: 1262 - DNA, 50 bp, Homo sapiens
ttgaagttttaagggacgtcagtgtttatgccatttttccagttccaaaa

SEQ ID NO: 1263 - DNA, 50 bp, Homo sapiens
ggtcggctcttatagagtggccatagtgttctgtcaaaacacttgcttcc

SEQ ID NO: 1264 - DNA, 50 bp, Homo sapiens
ttctccttcacagctaagatgccatgtgcaggtggattccatgccgcaga

SEQ ID NO: 1265 - DNA, 50 bp, Homo sapiens
catgattccaaggatcagcctggatgcctagaggactagatcaccttagt

SEQ ID NO: 1266 - DNA, 50 bp, Homo sapiens
agtgaagatctggctgaaccagttccacaaggttactgtatacatagcct

SEQ ID NO: 1267 - DNA, 50 bp, Homo sapiens
aggccatcattctatacctcatttaagccattgttatcaagggtttaccc

SEQ ID NO: 1268 - DNA, 50 bp, Homo sapiens
agagtacatggaaagttaggtgttcaaattcacatctaatttccctggga

SEQ ID NO: 1269 - DNA, 50 bp, Homo sapiens
gttttcagttttcccctttacagtcttctcccctcacctccaggaccctc

SEQ ID NO: 1270 - DNA, 50 bp, Homo sapiens
atccttcagaatgtgttggtttaccagtgacaccccatattcatcacaaa

SEQ ID NO: 1271 - DNA, 50 bp, Homo sapiens
gtctggccttggcttgctcggataaaactttgtatgtattttgtatggca

SEQ ID NO: 1272 - DNA, 50 bp, Homo sapiens
tgctgagcatggggaatgtggctgctgcagagacgttatgaaacacttct

SEQ ID NO: 1273 - DNA, 50 bp, Homo sapiens
tctccatccttgtgaatgtcctcgtctgtttcaaatacagtgcagtcagt

SEQ ID NO: 1274 - DNA, 51 bp, Homo sapiens
tggttcttctgatgagcaagggaacaacactgagaatgaggaggaaggagt

SEQ ID NO: 1275 - DNA, 50 bp, Homo sapiens
tgaagttaaggattacttggctgccatagcataacaatgaagtgactgaa

SEQ ID NO: 1276 - DNA, 50 bp, Homo sapiens
ggctttcttgttttggtgtcttggagtgctgggtaaggttcagtggatat

SEQ ID NO: 1277 - DNA, 50 bp, Homo sapiens
ctatctacaccatcatgcgctggttccggagacacaaggtgcgggctcac

SEQ ID NO: 1278 - DNA, 50 bp, Homo sapiens
gaagcggctggcaactgaaggctggaacacttgctactggataatcgtag

SEQ ID NO: 1279 - DNA, 50 bp, Homo sapiens
aagcaagagattgtaaaccgggtacagaatccaagagatgagagaggacc

SEQ ID NO: 1280 - DNA, 50 bp, Homo sapiens
agacgaatgcttgtcagttgtagctttccaggattctgctccaatgagga

SEQ ID NO: 1281 - DNA, 50 bp, Homo sapiens
caaactgattgcggggcagggacttgagtatggggagaggctgcaaaaga

SEQ ID NO: 1282 - DNA, 50 bp, Homo sapiens
gaacatcaggagaggagtccagagcccacgtctactgcggaaaagtcagg

SEQ ID NO: 1283 - DNA, 50 bp, Homo sapiens
agttggagagttactcgaacctcaggtgacagttgtaaggcagacatagt

SEQ ID NO: 1284 - DNA, 50 bp, Homo sapiens
ctcctccaggcctctcggatgcctctgttgggacagctaagttcctcttc

SEQ ID NO: 1285 - DNA, 50 bp, Homo sapiens
tcctccatatatccaaacaacaaagcataatatttcgcccactaagccaa

SEQ ID NO: 1286 - DNA, 50 bp, Homo sapiens
tgctgttgcaaaagaagaagacatctctgcctgagttttaattttgtcca

SEQ ID NO: 1287 - DNA, 50 bp, Homo sapiens
tttctgctggagtcccctgtgtcctcagccatcccaagaagggtttgctg

SEQ ID NO: 1288 - DNA, 50 bp, Homo sapiens
ctggttggatctgcatctcacgcccactgcacaccgttcctctccatctg

SEQ ID NO: 1289 - DNA, 50 bp, Homo sapiens
acctcgactccctggtgctctttgcagagttgggcagtgaaattaccttt

SEQ ID NO: 1290 - DNA, 50 bp, Homo sapiens
atacacagcacgacgtatccttgtaccgacttctcccggttcttgtttga

SEQ ID NO: 1291 - DNA, 50 bp, Homo sapiens
gtacttaggaagacacagctagatggacaacagcattgggaggcttagcc

SEQ ID NO: 1292 - DNA, 50 bp, Homo sapiens
catctctggttgtgtctgtgccgactcggtgttgaatcaaatcaggtgtg

SEQ ID NO: 1293 - DNA, 50 bp, Homo sapiens
caacaataggaggtggaatgctgcaaggggctgcaaatgagggcaatgca

SEQ ID NO: 1294 - DNA, 50 bp, Homo sapiens
atatttcactttacatccaaacatcactttggcttcgaagccgccgcctg

SEQ ID NO: 1295 - DNA, 50 bp, Homo sapiens
tggcaaattctgcgagtgtgataatttcaactgtgatagatccaatggct

SEQ ID NO: 1296 - DNA, 50 bp, Homo sapiens
tctcacatgtccatttgaaccacccaaaccaaaaacaaagcataagctgg

SEQ ID NO: 1297 - DNA, 50 bp, Homo sapiens
tccaggatgtctacaaaattggtggtattggtactgttcctgttggccga

SEQ ID NO: 1298 - DNA, 50 bp, Homo sapiens
tggacatagcagcacatactacttcagagttcatgatgtagatgtctggt

SEQ ID NO: 1299 - DNA, 50 bp, Homo sapiens
aacagaagacgaggacacagagcgagaataagcacaactcagacaacaca

SEQ ID NO: 1300 - DNA, 50 bp, Homo sapiens
tgaccacttatgcactttctgaatttgctttccatgctcagagttctgct

SEQ ID NO: 1301 - DNA, 50 bp, Homo sapiens
ctttgaccccaccttgtggaaacccagctgtctactggcagacattggtg

SEQ ID NO: 1302 - DNA, 50 bp, Homo sapiens
aaacaccagtttgcaggaagaaaggaagagaatggaaattgcttctggaa

SEQ ID NO: 1303 - DNA, 50 bp, Homo sapiens
ccctaccatgagccctacaaacaactaacctgccactaatagttatgtca

SEQ ID NO: 1304 - DNA, 50 bp, Homo sapiens
agtcgtattagagccttggcgtaatcatggtcatagctgtttcctgtgtg

SEQ ID NO: 1305 - DNA, 50 bp, Homo sapiens
ttgctgcctgatctgacatacatgatccatcgggttttgttacaaggaac

SEQ ID NO: 1306 - DNA, 50 bp, Homo sapiens
catgttcataggtaatctttgtactctgtgtgcagcagtatttggtttgc

SEQ ID NO: 1307 - DNA, 50 bp, Homo sapiens
aattcgccctatagtgagtcgattaccaatcactgcccgcgtttacaacg

SEQ ID NO: 1308 - DNA, 50 bp, Homo sapiens
acaggtaactgaagatcaaagtaaagcaacagaggaatgtacatctacct

SEQ ID NO: 1309 - DNA, 50 bp, Homo sapiens
aacagttgggcaccctgaatggcaaatggcaaatttggagcgctaataat

SEQ ID NO: 1310 - DNA, 50 bp, Homo sapiens
gccaatcactttattgactcctagccgcagacctcctcattctaacctga

SEQ ID NO: 1311 - DNA, 50 bp, Homo sapiens
atgtgggaggggcatggcagctatgaaggacctcctacctctggtttctg

SEQ ID NO: 1312 - DNA, 50 bp, Homo sapiens
catgggacggggagaaaaagcaaaccctggcacttgggaatacttatacc

SEQ ID NO: 1313 - DNA, 50 bp, Homo sapiens
ttgtgcccttgactgggtatttcttgaagcccttggatctacctttggtc

SEQ ID NO: 1314 - DNA, 50 bp, Homo sapiens
acataatacggttgtgcgagcagagaatctacctttccacttctaagcct

SEQ ID NO: 1315 - DNA, 50 bp, Homo sapiens
ccagcctttgcctcttccttcaatgtggtttccatgggaatttgcttcag

SEQ ID NO: 1316 - DNA, 50 bp, Homo sapiens
aaaacctcgagtcatggtgaatgagtgtctcggagttgctcgtgtgtgta

SEQ ID NO: 1317 - DNA, 50 bp, Homo sapiens
gtgagcacggacatgcggcatcatcgagtgagactggtgttccaagattc

SEQ ID NO: 1318 - DNA, 50 bp, Homo sapiens
caccacagtctcagtgcagggctgggaagtgaaagacgattcaccagacc

SEQ ID NO: 1319 - DNA, 50 bp, Homo sapiens
tttgtgggtgggtgattagtcgttgctgatgagatattttgagggtgggg

SEQ ID NO: 1320 - DNA, 50 bp, Homo sapiens
accttgtaagtgcctaagaaatgagactacaagctccatttcagcaggac

SEQ ID NO: 1321 - DNA, 50 bp, Homo sapiens
gccgagatctgctcagactacatggcttccactatagggttctacagtgt

SEQ ID NO: 1322 - DNA, 50 bp, Homo sapiens
aaatcagaattcatttagctcaccacatctcttgaatgtgattgacctac

SEQ ID NO: 1323 - DNA, 50 bp, Homo sapiens
aggtgtttaacagtgttattttgccactggtaatgtgtaaactgtgagtg

SEQ ID NO: 1324 - DNA, 50 bp, Homo sapiens
tggagtttccaggagaaaaataatcacctttgaaggtttttagagcatgt

SEQ ID NO: 1325 - DNA, 50 bp, Homo sapiens
ggtaacaacatccgtctgaaagggtcggacctcgtccaaaggagataggc

SEQ ID NO: 1326 - DNA, 50 bp, Homo sapiens
acattttgatttcttctctctgtggggtggcaagttgagggagcattctt

SEQ ID NO: 1327 - DNA, 50 bp, Homo sapiens
cgtaaaccaatgtggtacactagttggcccgaacttggtataaaccgcct

SEQ ID NO: 1328 - DNA, 50 bp, Homo sapiens
tctttaagtctgtcaaaccagaactctttgaagcactttgaacaatgccc

SEQ ID NO: 1329 - DNA, 50 bp, Homo sapiens
agctggcgtaatagcgaagaggcccgcaccgatcgcctttccaacaagtg

SEQ ID NO: 1330 - DNA, 50 bp, Homo sapiens
agatgcattttaaatgtctataaatggtgtcataactagagcacgggcgt

SEQ ID NO: 1331 - DNA, 50 bp, Homo sapiens
attaaaacgcttggaagaaaatccccttttggcaggtgggggaaaaagca

SEQ ID NO: 1332 - DNA, 50 bp, Homo sapiens
attcaaccaatagcccttgccgtaccgcctacccgtaacattactggagg

SEQ ID NO: 1333 - DNA, 50 bp, Homo sapiens
cgcctatagcactcgaataattcttctcaccctaacaggtcaacctcgct

SEQ ID NO: 1334 - DNA, 50 bp, Homo sapiens
gttgtgcatgattccccacgtgtctctgtttatccagataagaaaagata

SEQ ID NO: 1335 - DNA, 50 bp, Homo sapiens
tcttttaggatttgtcttttagaatctccagtcctcacaggaaaaccccc

SEQ ID NO: 1336 - DNA, 50 bp, Homo sapiens; identical to SEQ ID NO: 1167

SEQ ID NO: 1337 - DNA, 50 bp, Homo sapiens
acctcattctgacacctgcatatagtgtgggaaattgctctgcatttgac

SEQ ID NO: 1338 - DNA, 50 bp, Homo sapiens
gttctggaggacaggaagggtgacccacagaggattataccaccggggtg

SEQ ID NO: 1339 - DNA, 50 bp, Homo sapiens
gccgcagacctcctcattctaacctgaatcgaaggacaaccagtaagcta

SEQ ID NO: 1340 - DNA, 50 bp, Homo sapiens
tgagtcgtattacaattcactggccgtcgttttacaacgtcgtgactggg

SEQ ID NO: 1341 - DNA, 50 bp, Homo sapiens
taagattatcaaccttggggtcgttttgttgttcgcggattgagcacgga

SEQ ID NO: 1342 - DNA, 50 bp, Homo sapiens
ctgggctgaagcctattcctatggggctctggaatgtttgtgactgaatg

SEQ ID NO: 1343 - DNA, 50 bp, Homo sapiens
ttgtccatttggaacagagtcactataaagaacgggctcaactgggcacc

SEQ ID NO: 1344 - DNA, 50 bp, Homo sapiens
gcagacataggcgaagaaaacatggcattgagtgtgctgagtccagacaa

SEQ ID NO: 1345 - DNA, 50 bp, Homo sapiens
cttttcccaccccctccccctccatgtgaagatttgggtgcttaacatat

SEQ ID NO: 1346 - DNA, 50 bp, Homo sapiens
ggcactgcctccttacctgtgaggaatgcaaaataaagcatggattaagt

SEQ ID NO: 1347 - DNA, 50 bp, Homo sapiens
aaaccacaccaggaactccttgcatggcaaaagctgaacagtacaaatcc

SEQ ID NO: 1348 - DNA, 50 bp, Homo sapiens
acacagtcatccccatgcagaaacctcagaaaacaccaatgtattacaca

SEQ ID NO: 1349 - DNA, 50 bp, Homo sapiens
gtctgaacgagactcaattcctctccgaggctccccaaacaaattgtagc

SEQ ID NO: 1350 - DNA, 50 bp, Homo sapiens
gtgcagtccatcagatccaagcctgtctcttgaggaacaaccgcgcagac

SEQ ID NO: 1351 - DNA, 50 bp, Homo sapiens
gacccaggctatggatgaggctgactattactgtcaggcgtgggacagca

SEQ ID NO: 1352 - DNA, 50 bp, Homo sapiens
tggtggcaaatctgatttttggaaacgagtattggaggactataaaacaa

SEQ ID NO: 1353 - DNA, 50 bp, Homo sapiens
acatttcttgttggcactacagcaaccacatacagtacagacaacctcca

SEQ ID NO: 1354 - DNA, 50 bp, Homo sapiens
tgggataaaggtgtgtcggtttagcacctctggaagacctatctagagct

SEQ ID NO: 1355 - DNA, 50 bp, Homo sapiens
cctggcacatgttgtctggagtctggcacactggttatcaatagcacatt

SEQ ID NO: 1356 - DNA, 50 bp, Homo sapiens
gcatgttctcaccgtgaaggagagtgatgcagggagatactactgtgcag

SEQ ID NO: 1357 - DNA, 50 bp, Homo sapiens
aaagtgggtggaagacttcctggtgcaggaggctcactccgatttaaggt

SEQ ID NO: 1358 - DNA, 50 bp, Homo sapiens
ctgtggtctgttatatgagagagatcctttaactagagcaaagagggagt

SEQ ID NO: 1359 - DNA, 50 bp, Homo sapiens
gcttgctgttccttagaattttgccttgtaagttctagctcaagttgggg

SEQ ID NO: 1360 - DNA, 50 bp, Homo sapiens
tttctcagagctggaggttgctgggcacctaaatgatgtttcatgatagc

SEQ ID NO: 1361 - DNA, 50 bp, Homo sapiens
ctttttgtaagttacaacattccactggatccttatattgcctgtagtgg

SEQ ID NO: 1362 - DNA, 50 bp, Homo sapiens
ctcatctatgtcttctaaagcttttctgcattcttccacctgggattcaa

SEQ ID NO: 1363 - DNA, 50 bp, Homo sapiens
ctgtctttggaaggagacacaagaacctgataacattggttgtcttcggg

SEQ ID NO: 1364 - DNA, 50 bp, Homo sapiens
aaacaagaacccacttaaacacagcatcaaactctaccatgaaatgaaga

SEQ ID NO: 1365 - DNA, 50 bp, Homo sapiens
ttcttcctggtcatattcctcttttgattttctaagaacttccctcagga

SEQ ID NO: 1366 - DNA, 50 bp, Homo sapiens
acacaagatactgccactttctctacacaaagacccacccaaacaccagc

SEQ ID NO: 1367 - DNA, 50 bp, Homo sapiens
ctttctcaggaagtggctctgccaggcaggactatgtgggaaagggtttt

SEQ ID NO: 1368 - DNA, 50 bp, Homo sapiens
attacatgctaactcaaacttacaaaatcaagctctctgtgatcctggtt

SEQ ID NO: 1369 - DNA, 50 bp, Homo sapiens
gattaaaggcttccatcgattgggtagtgtccttcaagtgggtggcgaag

SEQ ID NO: 1370 - DNA, 50 bp, Homo sapiens
tgtattaacaggcttattgctatgcagggaaatagaaggggcattacaaa

SEQ ID NO: 1371 - DNA, 50 bp, Homo sapiens
tggtggatggatggaaacacatacctcctaattaacctgttggtggaaac

SEQ ID NO: 1372 - DNA, 50 bp, Homo sapiens
gccttggagtgtgacatttctgcgagaatgcttaaataccgatttcccgc

SEQ ID NO: 1373 - DNA, 50 bp, Homo sapiens
agggagtcgttttaccaattcactggcccgtgttttacaaacgtctgact

SEQ ID NO: 1374 - DNA, 50 bp, Homo sapiens
tggagagcttgggacaaggtcagaatgaaaacataccagtcaatcctgct

SEQ ID NO: 1375 - DNA, 50 bp, Homo sapiens
acctgtgctctttggatacctaatgcgacatttaagttgtatttgacagt

SEQ ID NO: 1376 - DNA, 50 bp, Homo sapiens
aggctgggcacaaaggagaaaggaggacatggaaaatccgacaattcgaa

SEQ ID NO: 1377 - DNA, 51 bp, Homo sapiens
atctcaaatccttgagcactcagtctagtgaagatgttgtcattatgtaca

SEQ ID NO: 1378 - DNA, 50 bp, Homo sapiens
gggtcataggttcatgggtttgttgagaattgtggctcctggtttctggt

SEQ ID NO: 1379 - DNA, 50 bp, Homo sapiens
gccttctttctgctgactgggggctttcatttaaaaggagtctttttaat

SEQ ID NO: 1380 - DNA, 50 bp, Homo sapiens
tgtaaacagtggcaggagcgtggacttaaaacaaggcttgcttatttggt

SEQ ID NO: 1381 - DNA, 50 bp, Homo sapiens
gccctttgggttaagcctttacattcatgaagacccctccagggtagaat

SEQ ID NO: 1382 - DNA, 50 bp, Homo sapiens
aaaaggaaaacgaaaaaggaaaaggtggccaatgtggaaaaagtttcaat

SEQ ID NO: 1383 - DNA, 50 bp, Homo sapiens
actctcaggagccatgaaagctgcacagttactttatataccacgaggca

SEQ ID NO: 1384 - DNA, 50 bp, Homo sapiens
ttatgtcaccagaatgtttgccaacaccccgaaaaggaaccagaggactt

SEQ ID NO: 1385 - DNA, 50 bp, Homo sapiens
aggttatttgagcacagtgaaagcagagtactatggttgtccaacacagg

SEQ ID NO: 1386 - DNA, 50 bp, Homo sapiens
ggcctgccatccgagggactgtgttgtagattgtgatcaaggttgattgg

SEQ ID NO: 1387 - DNA, 50 bp, Homo sapiens
acaggtagttgaataattgtttcaagagctcaacagatgacaagcttctt

SEQ ID NO: 1388 - DNA, 50 bp, Homo sapiens
aatacactttgtgccaagggaagaacactgcatgccctgggtcttcagtc

SEQ ID NO: 1389 - DNA, 50 bp, Homo sapiens
gggaactggaggtgagaagcattataatagcctctctgcctttatctaca

SEQ ID NO: 1390 - DNA, 50 bp, Homo sapiens
acaagccaaagtggcatgttttgtgcatttgtaaatgctgtgttgggtag

SEQ ID NO: 1391 - DNA, 50 bp, Homo sapiens
aacagactgtcgtagaaaactgtctttgcttccaaatcagcagaggacca

SEQ ID NO: 1392 - DNA, 50 bp, Homo sapiens
gcccctcagaagagccaaactttgagttttatgtctgtttgtcattgata

SEQ ID NO: 1393 - DNA, 50 bp, Homo sapiens
ccttgtgtccaacgggaataggaagaattagttactgacttcacctgaga

SEQ ID NO: 1394 - DNA, 50 bp, Homo sapiens
cccacaattggactgatagggggagaaaatccaaagagacggagcaactg

SEQ ID NO: 1395 - DNA, 50 bp, Homo sapiens
aacggcaactgggagatttgtgagtgaacactgtttcatcttaatatgct

SEQ ID NO: 1396 - DNA, 50 bp, Homo sapiens
acatctgagaaaccctgaatcctgcaatcaagtagaagtcaacttcatct

SEQ ID NO: 1397 - DNA, 50 bp, Homo sapiens
gccataggaaggtttaccagtagaatccttgctaggttgatgtgggccat

SEQ ID NO: 1398 - DNA, 50 bp, Homo sapiens
tcatctcaacttagtattatacccacacccacccaagaacagggtttgtt

SEQ ID NO: 1399 - DNA, 50 bp, Homo sapiens
gactgaaagatttagccataatgtaaactgcctcaaattggactttgggc

SEQ ID NO: 1400 - DNA, 50 bp, Homo sapiens
ggcactgtctgtgtccttccttgaactgtctaccctgttgcttttcacaa

SEQ ID NO: 1401 - DNA, 50 bp, Homo sapiens
ggccagccgaggctacaaaaactaaccctggatcctactctcttattaaa

SEQ ID NO: 1402 - DNA, 50 bp, Homo sapiens
actaggttgcaatatgtgaaatcagaggaccaaagtacagatggaaacca

SEQ ID NO: 1403 - DNA, 50 bp, Homo sapiens
ccctgtctgactacaacatccagaaagagtccactctgcacttggtcctg

SEQ ID NO: 1404 - DNA, 50 bp, Homo sapiens
ggcatcgcccatgctcctcacctgtattttgtaatcagaaataaattgct

SEQ ID NO: 1405 - DNA, 50 bp, Homo sapiens
aaagcaacgaaaggaacgcaagaacagaatgaagaaagtcagggggactg

SEQ ID NO: 1406 - DNA, 50 bp, Homo sapiens
tcccactttgtctgtacatactggcctctgtgattacatagatcagccat

SEQ ID NO: 1407 - DNA, 50 bp, Homo sapiens; identical to SEQ ID NO: 1278

SEQ ID NO: 1408 - DNA, 50 bp, Homo sapiens
cagtcacgtcagttatgtagatactgcatggcaggagagctttacgctaa

SEQ ID NO: 1409 - DNA, 50 bp, Homo sapiens
gccacccctcacacagccaaaccccagatcatctgaaactactaactttg

SEQ ID NO: 1410 - DNA, 50 bp, Homo sapiens
gcaggtgaccattggcacacgctagaagtttatggcagagctttacaaat

SEQ ID NO: 1411 - DNA, 50 bp, Homo sapiens
tgccatgctgctaggaaattgtcctttttctttctagctgttaacctact

SEQ ID NO: 1412 - DNA, 50 bp, Homo sapiens
aacttattccagtgttgatcgcaagctgttgatgcacaggcgtcttgtgg

SEQ ID NO: 1413 - DNA, 50 bp, Homo sapiens
tgaaaaggattaaagctggtattctagaacatgcccttcactggttgtgt

SEQ ID NO: 1414 - DNA, 50 bp, Homo sapiens
ggtaaggtttctaggaggtctgttaggtgtacatcctgcagcttattggc

SEQ ID NO: 1415 - DNA, 50 bp, Homo sapiens
tgattctgtaaagctgtggaatgaagctgcagatttagagaacattggct

SEQ ID NO: 1416 - DNA, 50 bp, Homo sapiens
cgattttacacggctgggtagaatttgtagaaaagatccacagggcaagc

SEQ ID NO: 1417 - DNA, 50 bp, Homo sapiens
gctactacttcattgcaacctttattactgaccacatcagacatcatgct

SEQ ID NO: 1418 - DNA, 50 bp, Homo sapiens
gggctgaagtacctaagtgtgaatgtctctcccgttaaactgagtgtaga

SEQ ID NO: 1419 - DNA, 50 bp, Homo sapiens
aggaaaacggttcaccagtgtttagttttatattgaggtgctcaggttgg

SEQ ID NO: 1420 - DNA, 50 bp, Homo sapiens
ccgggccttgcatataaataacggagcatacagtgagcacatctagctga

SEQ ID NO: 1421 - DNA, 50 bp, Homo sapiens
ataatgaaagctaagcctcgggctaatttccccatagccgtggggtgact

SEQ ID NO: 1422 - DNA, 50 bp, Homo sapiens; identical to SEQ ID NO: 75

SEQ ID NO: 1423 - DNA, 50 bp, Homo sapiens
tgctctgttctggtttctgttttcaaatcaaatgcctgtttgggaggaga

SEQ ID NO: 1424 - DNA, 50 bp, Homo sapiens
caaaatcccaaaaccagggccaaggagtggacgcttctcttgtgagccag

SEQ ID NO: 1425 - DNA, 50 bp, Homo sapiens
acaaatttcttggctggatttgaagcttaaactcctgtggattcacatca

SEQ ID NO: 1426 - DNA, 50 bp, Homo sapiens
tccacggttgtgccttattgttccattaaaattgtatcttcgatccatca

SEQ ID NO: 1427 - DNA, 50 bp, Homo sapiens
ggtctgagagtctgtgaagatggcccagtcttctatcccccacctaaaaa

SEQ ID NO: 1428 - DNA, 50 bp, Homo sapiens
acacacaggagggaaaatcctgggattctttttctagggatgtaatacat

SEQ ID NO: 1429 - DNA, 50 bp, Homo sapiens
ctgtttgaactgttgagtttccgttgctggctgagtgcgttttgtccttc

SEQ ID NO: 1430 - DNA, 50 bp, Homo sapiens; identical to SEQ ID NO: 1427

SEQ ID NO: 1431 - DNA, 50 bp, Homo sapiens
ggtacagagaagccagcttgtttacatgcttattccatgactgcttgccc

SEQ ID NO: 1432 - DNA, 50 bp, Homo sapiens; identical to SEQ ID NO: 1431

SEQ ID NO: 1433 - DNA, 50 bp, Homo sapiens
gggagaatgaatgtgcaacgtggctgaaatctattttgtgtaataaaagg

SEQ ID NO: 1434 - DNA, 50 bp, Homo sapiens
ccccaccaccccattaccacagctgcctttgtgtgtttgtgtcaataaaa

SEQ ID NO: 1435 - DNA, 50 bp, Homo sapiens
ccagcaagataatgtcctgtcttctaagatgtgcatcaagcctggtacat

SEQ ID NO: 1436 - DNA, 50 bp, Homo sapiens; identical to SEQ ID NO: 1052

SEQ ID NO: 1437 - DNA, 50 bp, Homo sapiens
gctactagagagcaaggggctttcttaccaccagtgctgaggagaaaagt

SEQ ID NO: 1438 - DNA, 50 bp, Homo sapiens
accaagaaaccagcccctgaaaagaagcctgcagagaagaaacctactac

SEQ ID NO: 1439 - DNA, 50 bp, Homo sapiens
tttcctcatctatgaattgtcattcacacacctacttttctgcttcgttt

SEQ ID NO: 1440 - DNA, 50 bp, Homo sapiens; identical to SEQ ID NO: 1439

SEQ ID NO: 1441 - DNA, 50 bp, Homo sapiens
aataatgacaaatgccctgcacctacccacatgcactcgtgtgagacaag

SEQ ID NO: 1442 - DNA, 50 bp, Homo sapiens
gtgcccctgtgggtcccagggaggtcttaaacaaggtatttttcaactta

SEQ ID NO: 1443 - DNA, 50 bp, Homo sapiens
cagtgaagacgtcaggggcaaggtctcgggggtccggaagggtgatcatc

SEQ ID NO: 1444 - DNA, 50 bp, Homo sapiens
tgcaagggagacatatcctagatcactttgctttttctttaaggagctga

SEQ ID NO: 1445 - DNA, 50 bp, Homo sapiens; identical to SEQ ID NO: 75

SEQ ID NO: 1446 - DNA, 50 bp, Homo sapiens
ttgggggaggttagggacttatcctgtgcttgtaaataaataaggtcatg

SEQ ID NO: 1447 - DNA, 50 bp, Homo sapiens
acttggctgccatagcataacaatgaagtgactgaaaaatccagaatttc

SEQ ID NO: 1448 - DNA, 50 bp, Homo sapiens
aaaatattaaacacaaactaccacctacctccctcaccaaagcccataaa

SEQ ID NO: 1449 - DNA, 50 bp, Homo sapiens
agctgtttggtaaccatagtttcacttgttcaaagctgtgtaatcgtggg

SEQ ID NO: 1450 - DNA, 50 bp, Homo sapiens; identical to SEQ ID NO: 1449

SEQ ID NO: 1451 - DNA, 50 bp, Homo sapiens
tgtcgccttttagaaggagaaacttaagtgtggaatgcattatatgggca

SEQ ID NO: 1452 - DNA, 50 bp, Homo sapiens; identical to SEQ ID NO: 1124

SEQ ID NO: 1453 - DNA, 50 bp, Homo sapiens
tttggagtggaggcattgtttttaagaaaaacatgtcatgtaggttgtct

SEQ ID NO: 1454 - DNA, 50 bp, Homo sapiens
tggctgggacgctagaagggtcatgtgttaactataatcacatttatggt

SEQ ID NO: 1455 - DNA, 50 bp, Homo sapiens
attctggttaaccgctcacatgcataacaataatgctagaaattcaggaa

SEQ ID NO: 1456 - DNA, 50 bp, Homo sapiens
tgctgatttctagtgtatactctgtagtctcagttcgtgtttgattccat

SEQ ID NO: 1457 - DNA, 50 bp, Homo sapiens
aaatgaatctttcaaaggtttcccaaaccactccttatgatccagtgata

SEQ ID NO: 1458 - DNA, 50 bp, Homo sapiens; identical to SEQ ID NO: 1124

SEQ ID NO: 1459 - DNA, 50 bp, Homo sapiens
tgcgtgtgcctcagtttcctcctccacaactgaatatttatagtggctga

SEQ ID NO: 1460 - DNA, 50 bp, Homo sapiens
gggatgtggaggatttttgttaagtgtcaatcgaagttaaaaagcaaggg

SEQ ID NO: 1461 - DNA, 50 bp, Homo sapiens
agctctctgcacccttacccctttccaccttttgtatttaattttaaagt

SEQ ID NO: 1462 - DNA, 50 bp, Homo sapiens
ccctccagccaataggcagctttcttaactatcctaacaagccttggacc

SEQ ID NO: 1463 - DNA, 50 bp, Homo sapiens
cgtggttgtgggaggggaaagaggaaacagagctagtcagatgtgaattg

SEQ ID NO: 1464 - DNA, 50 bp, Homo sapiens
acaatgtgttagcagaaaccagtgggttataatgtagaatgatgtgcttt

SEQ ID NO: 1465 - DNA, 50 bp, Homo sapiens
gctagatccccggtggttttgtgctcaaaataaaaagcctcagtgaccca

SEQ ID NO: 1466 - DNA, 50 bp, Homo sapiens; identical to SEQ ID NO: 1425

SEQ ID NO: 1467 - DNA, 50 bp, Homo sapiens
gctgtggttggttgcattacatgacacagaaaactgtcctctacctcacg

SEQ ID NO: 1468 - DNA, 50 bp, Homo sapiens
gccctggtaggctcctttagaaggaccatttctgttcctagagcttaact

SEQ ID NO: 1469 - DNA, 50 bp, Homo sapiens; identical to SEQ ID NO: 1404

SEQ ID NO: 1470 - DNA, 50 bp, Homo sapiens
tttccctctcctgtccttgtgttgaaggcagtaaactaagggtgtcaagc

SEQ ID NO: 1471 - DNA, 50 bp, Homo sapiens
agactggaaatggggatgagggtgtaaattgtattgaaaaagatcgcgaa

SEQ ID NO: 1472 - DNA, 50 bp, Homo sapiens
ccatgagttgtttggttttccagaagctgccagtgggttcccgtgaattg

SEQ ID NO: 1473 - DNA, 50 bp, Homo sapiens
gatacgatgagatccgccgtcactggggtggcaatgtcctgggtcctaag

SEQ ID NO: 1474 - DNA, 50 bp, Homo sapiens
agtctttctggtttctggagataacccatcaataaagctgcttcctctgg

SEQ ID NO: 1475 - DNA, 50 bp, Homo sapiens
cgatgatggttacccttcatggacgtcttaatcttccacacacatcccct

SEQ ID NO: 1476 - DNA, 50 bp, Homo sapiens
ggcccctggacatgtacctgcagaataataaagtcatcaatacctaaaaa

SEQ ID NO: 1477 - DNA, 50 bp, Homo sapiens
gcaaacctgcagattcccaagatgttcacgagcttgtgctttctaaagaa

SEQ ID NO: 1478 - DNA, 50 bp, Homo sapiens
tccccattgtgccgcctttatcaattgcctgttttgttttgtttgttttt

SEQ ID NO: 1479 - DNA, 50 bp, Homo sapiens
ctttagctgctgttgcctcccttctcaggctggtgctggatccttcctag

SEQ ID NO: 1480 - DNA, 50 bp, Homo sapiens
ctgcttatggcacaatttgcctcaaaatccattccaagttgtatatttgt

SEQ ID NO: 1481 - DNA, 50 bp, Homo sapiens
ctgcttctgggtgcatggtagactttgtggcatttgatacaacttggaca

SEQ ID NO: 1482 - DNA, 50 bp, Homo sapiens
cttatagtatttatccacccaaaccccagactgagatactgctcccaggg

SEQ ID NO: 1483 - DNA, 50 bp, Homo sapiens
gagagaccagcctttcttcctttggtaggaatggcctgagttggcgttgt

SEQ ID NO: 1484 - DNA, 50 bp, Homo sapiens
cagaggtgggagtaactgctggtagtgccttctttggttgtgttgctcag

SEQ ID NO: 1485 - DNA, 50 bp, Homo sapiens
ctgtgtgccccagctgcatcagccagcttctaggtggctccattgttttc

SEQ ID NO: 1486 - DNA, 50 bp, Homo sapiens
agagcagaatagcaatataagagcacagacgaacatagacacgacagcga

SEQ ID NO: 1487 - DNA, 50 bp, Homo sapiens
ctattaggacccagtgattatgctaccttggcacggttagggtactgcgg

SEQ ID NO: 1488 - DNA, 50 bp, Homo sapiens
aaagaagcatgcacacttatcacaaacaactctctcaggtggccagtctg

SEQ ID NO: 1489 - DNA, 50 bp, Homo sapiens
tgctgcctatatgaagtctttgagaaagcccctcttggagtctgtgcctt

SEQ ID NO: 1490 - DNA, 50 bp, Homo sapiens
gatatacgaggacaaaacccatctaccaggcagctaacaaaccgccgcca

SEQ ID NO: 1491 - DNA, 50 bp, Homo sapiens
gccactttattagtaatggtcgatagtccgaatcgatggctagggtgact

SEQ ID NO: 1492 - DNA, 50 bp, Homo sapiens
taatctggcgggttatacccccgtgttctccggattatatttcgggacac

SEQ ID NO: 1493 - DNA, 50 bp, Homo sapiens
gctggatttgtgggtatgggggcggtttttgggcgaaggttggttgttac

SEQ ID NO: 1494 - DNA, 50 bp, Homo sapiens
ccacatcatcgggggcgaaatagaagcccagagagaggctaggtgtagga

SEQ ID NO: 1495 - DNA, 50 bp, Homo sapiens
agggagactctcagccttcagcttcctaaattctgtgtctgtgactttcg

SEQ ID NO: 1496 - DNA, 50 bp, Homo sapiens
ttgtcaagctgctgctgtcttcaagatctacctggtcagaatctcctgct

SEQ ID NO: 1497 - DNA, 50 bp, Homo sapiens
ggccagtctctatgtgtcttaatcccttgtccttcattaaaagcaaaact

SEQ ID NO: 1498 - DNA, 50 bp, Homo sapiens
tctctcacattctgtctttcccctcctccttcaccttccctccgtccctc

SEQ ID NO: 1499 - DNA, 50 bp, Homo sapiens
acacgagactatagagaatgcagcacacagatgagagcagagcaaataga

SEQ ID NO: 1500 - DNA, 50 bp, Homo sapiens
gcatccagatggtggtttactctgcaacagtctaatgttcttcacttcca

SEQ ID NO: 1501 - DNA, 50 bp, Homo sapiens
ggggttttcaccctacctaaagatgctttaattgctgttttccaaattgt

SEQ ID NO: 1502 - DNA, 50 bp, Homo sapiens
atgcctaacaagcaacatgatcctataaatccaccccaagccaatctggt

SEQ ID NO: 1503 - DNA, 50 bp, Homo sapiens
ccaccatctggtacgtttttacttcctcacccgcgtgtactccgattacc

SEQ ID NO: 1504 - DNA, 50 bp, Homo sapiens
gagtatattcccccagttatttgctcttccccacacagggtggtagtacc

SEQ ID NO: 1505 - DNA, 50 bp, Homo sapiens
caaaggaaggggcgtgaaggggtgagaaaaatatgggacccaaattgtgg

SEQ ID NO: 1506 - DNA, 50 bp, Homo sapiens
tttccttacaggcggtaacaccggtccacacagttcttgccaaaacaaag

SEQ ID NO: 1507 - DNA, 50 bp, Homo sapiens
aattttctctcacctcatcactcgggacctccccagtgataataacccgg

SEQ ID NO: 1508 - DNA, 50 bp, Homo sapiens
gcgggtgtaaggggatatcttgataaactggagcccaggaagattacaaa

SEQ ID NO: 1509 - DNA, 50 bp, Homo sapiens
acgccgacaatcaagaaaatgtgagttataacggacaaggttgtattatg

SEQ ID NO: 1510 - DNA, 50 bp, Homo sapiens
gatattggtagtaaaggggttacctgtgaacttccaaaattccttggggc

SEQ ID NO: 1511 - DNA, 50 bp, Homo sapiens
taaagatgtccgggtacacttcgccaagggttagcgtctttgggcatttc

SEQ ID NO: 1512 - DNA, 50 bp, Homo sapiens
tcctaatttcttctgtgaaccttctcaaatcccccagcatgcgtgtagtg

SEQ ID NO: 1513 - DNA, 50 bp, Homo sapiens
ctgcatgatgtcatcaacctgctgtagtgcggaaacgaccacaacacaca

SEQ ID NO: 1514 - DNA, 50 bp, Homo sapiens
aaagacgaacgagacacgaaagcaacgaacgaacacagagcacgccgcac

SEQ ID NO: 1515 - DNA, 50 bp, Homo sapiens
tttcaacacgcatcccttatgggcgaactgtcctcaaacaacaacaagtg

SEQ ID NO: 1516 - DNA, 50 bp, Homo sapiens
taggacgagaaacgaagaaggacagagcgagaacaagtaagcagggacac

SEQ ID NO: 1517 - DNA, 50 bp, Homo sapiens
ggtggagaatcaaaacgaccccgcaaataaacatggcgatttggcttggg

SEQ ID NO: 1518 - DNA, 50 bp, Homo sapiens
tggccttttaaataactgggcttctcacaaccatagtgaacagaaacagc

SEQ ID NO: 1519 - DNA, 50 bp, Homo sapiens
attgtgacatggtgatgcctcattgctgatatggtcctgtggttatgtgc

SEQ ID NO: 1520 - DNA, 50 bp, Homo sapiens
ggaagagataacaccacaacgaaagagcaggcaagagagaccaaagcaca

SEQ ID NO: 1521 - DNA, 50 bp, Homo sapiens
ggtaaaaggcgttactctccgccctcttcaaggaacggccaagagtataa

SEQ ID NO: 1522 - DNA, 50 bp, Homo sapiens
acccaagggtctcgccagtggggttaagtcacaatattactacacaaggg

SEQ ID NO: 1523 - DNA, 50 bp, Homo sapiens
acagtacacaatcacctgcaagggacatagcacacaaaccgctaaagagg

SEQ ID NO: 1524 - DNA, 50 bp, Homo sapiens
tctcacagcgagaggaggagacgggatgaccgagaggtagacgattatac

SEQ ID NO: 1525 - DNA, 50 bp, Homo sapiens
cgctggtgttgtccccaagtgatttattctactggagtgcctggtgtctt

SEQ ID NO: 1526 - DNA, 50 bp, Homo sapiens
ttccggcttttaacaaacacacaccacactaacacaacaacacaaacaaa

SEQ ID NO: 1527 - DNA, 50 bp, Homo sapiens
aagacttgcctctttaaaattgctttgttttctgcagtactatctgtggt

SEQ ID NO: 1528 - DNA, 50 bp, Homo sapiens
gaactcgtccactcttctcgggccactattctggttcagggaatcttggg

SEQ ID NO: 1529 - DNA, 50 bp, Homo sapiens
agcaataaaccgaagcagctagacagcgaagaagtacagcaaagagacga

SEQ ID NO: 1530 - DNA, 50 bp, Homo sapiens
cgcccatactagagaagtttgccctctattgtctctcacaccacaatgag

SEQ ID NO: 1531 - DNA, 50 bp, Homo sapiens
cacagacatccacggacacaaaaggcggggaccaccaccacaatgaacac

SEQ ID NO: 1532 - DNA, 50 bp, Homo sapiens
gcgtcgattgatatcagacagcatcgtctctgcgagcacaaagatctgtt

SEQ ID NO: 1533 - DNA, 50 bp, Homo sapiens
ggaacagggttaatggccaggccctttgccgccccttttaaagggaatcc

SEQ ID NO: 1534 - DNA, 50 bp, Homo sapiens
acagagtaacatgggatatgggtatgagtgggatgtgctgagaaggaact

SEQ ID NO: 1535 - DNA, 50 bp, Homo sapiens
gggggcaaagaaagtacattgggtgaaaatttaaaaaggtatggagcatt

SEQ ID NO: 1536 - DNA, 50 bp, Homo sapiens
caaacgaacagcgaagacaacaactcacgatgctgcacaacgcgaccaac

SEQ ID NO: 1537 - DNA, 50 bp, Homo sapiens
acattttataaggcatttgtgttagccactcagtcatctttgggtgctgc

SEQ ID NO: 1538 - DNA, 50 bp, Homo sapiens
gtcacagcaacgtgtcgctccccagatcatttattagcgtcgattgttgt

SEQ ID NO: 1539 - DNA, 50 bp, Homo sapiens
attccaaacgggatctgctgagacctcacagaggtgggccgcgattataa

SEQ ID NO: 1540 - DNA, 50 bp, Homo sapiens
cctagggtgaaacacgtgacagaagaataaagactattgaatagtcctct

SEQ ID NO: 1541 - DNA, 50 bp, Homo sapiens; identical to SEQ ID NO: 1315

SEQ ID NO: 1542 - DNA, 50 bp, Homo sapiens
ccccttgtttactctgtctgtatgtatgtcaaaagcgtggcaaaacctct

SEQ ID NO: 1543 - DNA, 50 bp, Homo sapiens
catgatctcagaggaaactgtcgctgaccctggacatgggtacgtttgac

SEQ ID NO: 1544 - DNA, 50 bp, Homo sapiens
cctctacctgcacgacaatacataatgacccaccaatcacatgcctatca

SEQ ID NO: 1545 - DNA, 50 bp, Homo sapiens
atttggaagcgccaccctagcaaatatacaaaccattaaaccttccctct

SEQ ID NO: 1546 - DNA, 50 bp, Homo sapiens
tttaccaatgattttcaggtgacctgggctaagtcatttaaactgggtct

SEQ ID NO: 1547 - DNA, 50 bp, Homo sapiens
agtttacatatcgacagcatatccactgatttctaaatgggctggtccca

SEQ ID NO: 1548 - DNA, 50 bp, Homo sapiens
atctggagtgggacccttcaaaccatgtctgtgcttatgcgggaaacaat

SEQ ID NO: 1549 - DNA, 50 bp, Homo sapiens
gcggagagaagaagaggtagatatgagaacagtgtgtggtatatgatagt

SEQ ID NO: 1550 - DNA, 50 bp, Homo sapiens
gaaatcccaccggcaagttaaggtcacggagcaagtgaataaacgcggag

SEQ ID NO: 1551 - DNA, 50 bp, Homo sapiens
gtgatcaaacaaattcacagcacagacaccgcgcaacaacgcaacttctc

SEQ ID NO: 1552 - DNA, 50 bp, Homo sapiens
ggtatttgtgttgttgagtattgtgtctgggtgtgggtatttgattcttt

SEQ ID NO: 1553 - DNA, 50 bp, Homo sapiens
gggttcgtccagggctgcgctaaattattctcaatgatttgtctctttgc

SEQ ID NO: 1554 - DNA, 50 bp, Homo sapiens
caatgacgcagtcggaccctcggatccaagtcctgctttgggtgtggacc

SEQ ID NO: 1555 - DNA, 50 bp, Homo sapiens
gggttataatagatggacgggtctttcacggtggtgacagcaccctttcc

SEQ ID NO: 1556 - DNA, 50 bp, Homo sapiens
tccgctgcaatttgagtttagctttacagattgtgccgggtgtttaacct

SEQ ID NO: 1557 - DNA, 50 bp, Homo sapiens
ctccttcccaaagacttgagtggaacttccctttcatgtgcgtatcggtc

SEQ ID NO: 1558 - DNA, 50 bp, Homo sapiens
aaattagtcgccttcgtcgagagtgcccttctgatgaatgtggtgctggg

SEQ ID NO: 1559 - DNA, 50 bp, Homo sapiens
gacagtactcctaagacccctgtgtgtgtcccgatgagatcatgactggg

SEQ ID NO: 1560 - DNA, 50 bp, Homo sapiens
catgcccatcgtcctagaattaattcccctaaaaatctttgaaatagggc

SEQ ID NO: 1561 - DNA, 50 bp, Homo sapiens
ggcgtatcatcaactggtgagcccgaagggatattatttctaaggcctct

SEQ ID NO: 1562 - DNA, 50 bp, Homo sapiens
ccagaatcgtaagggggctgacggaggatgagagggggcacccagagatc

SEQ ID NO: 1563 - DNA, 50 bp, Homo sapiens
cggtgttttctgatcggtttttgttttctgcttacatatgatgtacttgt

SEQ ID NO: 1564 - DNA, 50 bp, Homo sapiens
acagaatgcagcggtgcaacaccggcaaggttccacacgccacaaagaaa

SEQ ID NO: 1565 - DNA, 50 bp, Homo sapiens
tggaagtgaagtctatgatgtgaaacactttgcctcctgtgtactgtgtc

SEQ ID NO: 1566 - DNA, 50 bp, Homo sapiens
ccaaaaagcttcatttttctatataggctgcacaagagccttgattgaag

SEQ ID NO: 1567 - DNA, 50 bp, Homo sapiens
tcacaagacagtcatcagaaccagtaaatatccgtctgccagttcgatca

SEQ ID NO: 1568 - DNA, 50 bp, Homo sapiens; identical to SEQ ID NO: 1567

SEQ ID NO: 1569 - DNA, 50 bp, Homo sapiens
gctgtcatttgtacatttaaagcagctgttttggggtctgtgagagtaca

SEQ ID NO: 1570 - DNA, 50 bp, Homo sapiens
tatcctgagtcccttaatcttatggggccggaaggaatgtcagggccagg

SEQ ID NO: 1571 - DNA, 50 bp, Homo sapiens
ctctgccttcggagggaaattgtaaatcctgtgtttcattacttgaatgt

SEQ ID NO: 1572 - DNA, 50 bp, Homo sapiens
aaactcctgcttaaggtgttctaattttctgtgagcacactaaaagcgaa

SEQ ID NO: 1573 - DNA, 50 bp, Homo sapiens
gggtgcacgttcctcctggttccttcgcttgtgtttctgtacttaccaaa

SEQ ID NO: 1574 - DNA, 50 bp, Homo sapiens
ggggttgggaggaagtgtctactaggagggtgggtgagatctgtgttgat

SEQ ID NO: 1575 - DNA, 50 bp, Homo sapiens
atctaccctccgattgttcctgaaccgatgagaaataaagtttctgttga

SEQ ID NO: 1576 - DNA, 50 bp, Homo sapiens
aagtcttatgccaaattcagtgctactcctcgttacatgacatacaactg

SEQ ID NO: 1577 - DNA, 50 bp, Homo sapiens
cacacggaggcatctgcaccctcgatgaagcccaataaacctcttttctc

SEQ ID NO: 1578 - DNA, 50 bp, Homo sapiens
acaacgtcgtgactgggaaaaccctggcgttacccaacttaatcgccttg

SEQ ID NO: 1579 - DNA, 50 bp, Homo sapiens
ccaagcctccaagtgggaagaaagactgggatgatgaccaaaatgattga

SEQ ID NO: 1580 - DNA, 50 bp, Homo sapiens
caactacttgtggcatgcattggcactcggaataaagcgcactattgtca

SEQ ID NO: 1581 - DNA, 50 bp, Homo sapiens
gaaggggtagggtccaccatactggtaattggggtactctgtatatgtgt

SEQ ID NO: 1582 - DNA, 50 bp, Homo sapiens
gctcagttccatatttcatccgtgaaaaacttgcaatacgagcagtttca

SEQ ID NO: 1583 - DNA, 50 bp, Homo sapiens
aattgtcatttacctgggtatgaattccctgacacacattcatgtcaaca

SEQ ID NO: 1584 - DNA, 50 bp, Homo sapiens
gtgacttgactgtggaagatgatggttgcatgtttctagtttgtatatgt

SEQ ID NO: 1585 - DNA, 50 bp, Homo sapiens
cagtgctgtaatacagacggcaatgcaatagcctatttaaagaactacgt

SEQ ID NO: 1586 - DNA, 50 bp, Homo sapiens
agctggtggatggtgacttttgaagaacaaaaggctttggcaacagaaaa

SEQ ID NO: 1587 - DNA, 50 bp, Homo sapiens
tctgttgtcactaaagactaaatgagggtttgcagttgggaaagaggtca

SEQ ID NO: 1588 - DNA, 50 bp, Homo sapiens
gcggagttgaccaaaataatatctgaggatgattgcttttccctgctgcc

SEQ ID NO: 1589 - DNA, 50 bp, Homo sapiens
catcttgaacttggcctgagaacattttctgggaagaggtaagggtgaca

SEQ ID NO: 1590 - DNA, 50 bp, Homo sapiens
tctgtggaatctccttcattggcattgttatttaatcataaacggggcag

SEQ ID NO: 1591 - DNA, 50 bp, Homo sapiens
tgtactgttcatgctgacacagatatttcagtctgcatggtaaaagttct

SEQ ID NO: 1592 - DNA, 50 bp, Homo sapiens
taatggggtttatatggactttcttctcataaatggcctgccgtctccct

SEQ ID NO: 1593 - DNA, 50 bp, Homo sapiens; identical to SEQ ID NO: 1438

SEQ ID NO: 1594 - DNA, 50 bp, Homo sapiens
agtcctgtgtgcttccctctcttatgactgtgtccctggttgtcaataaa

SEQ ID NO: 1595 - DNA, 50 bp, Homo sapiens
acccaccacctcttgcactctcgcttttggagcaagttgcattaactatt

SEQ ID NO: 1596 - DNA, 50 bp, Homo sapiens
tgacagttgcagaattgtggagtgtttttacattgatcttttgctaatgc

SEQ ID NO: 1597 - DNA, 50 bp, Homo sapiens
atgacagacacacgtatctaacaaacaaacaaacagtgaccttctccatg

SEQ ID NO: 1598 - DNA, 50 bp, Homo sapiens
gcaagggataatacaaatcctatgatctctatgcccaatatgctgcctca

SEQ ID NO: 1599 - DNA, 50 bp, Homo sapiens
agtacttttcacagcgtggcctttcaccataattttatatttctccccct

SEQ ID NO: 1600 - DNA, 50 bp, Homo sapiens
tcttaagagccagagccatataagcatcttgggaaagcaagtttgaacca

SEQ ID NO: 1601 - DNA, 50 bp, Homo sapiens
aagccggtcatgagattatatgtggtaaagttaattgactaacaacccca

SEQ ID NO: 1602 - DNA, 50 bp, Homo sapiens
agggggctgtgtctgatcttggtgttcaaaacagaactgtatttttgcct

SEQ ID NO: 1603 - DNA, 50 bp, Homo sapiens
gttcatagcttcctgcaacttgacagagcctgagtttgcctcttagtggg

SEQ ID NO: 1604 - DNA, 50 bp, Homo sapiens
catatgggagaagggggagtaatgacttgtacaaacagtatttctggtgt

SEQ ID NO: 1605 - DNA, 50 bp, Homo sapiens
acatgtgatgtttgactgtaccattgactgttatggaagttcagcgttgt

SEQ ID NO: 1606 - DNA, 50 bp, Homo sapiens
tcttgcttttattcctttttgttgttggccttgtgctgcgtttgtttaca

SEQ ID NO: 1607 - DNA, 50 bp, Homo sapiens
agtgttgttttctcctctttaatattgctgtgaacagtggtgcccattgt

SEQ ID NO: 1608 - DNA, 50 bp, Homo sapiens
aattcttgtgtgctgctttccatttgacaccgcagttctgttcagccatc

SEQ ID NO: 1609 - DNA, 50 bp, Homo sapiens
gaggtgtctccatctctgcctcaacttcatggtgcactgagctgtaactt

SEQ ID NO: 1610 - DNA, 50 bp, Homo sapiens; identical to SEQ ID NO: 276

SEQ ID NO: 1611 - DNA, 50 bp, Homo sapiens
tattttcttccattcttgtcattggtcaataggggagggtagattagctg

SEQ ID NO: 1612 - DNA, 50 bp, Homo sapiens
tcccctgcttccactaaatccagttgtgacaaaatctaacgtgacatcag

SEQ ID NO: 1613 - DNA, 50 bp, Homo sapiens
acctggtcaacttagcttttaagcagacgatgctgtaaaaactaacggct

SEQ ID NO: 1614 - DNA, 50 bp, Homo sapiens
acctgggatgcccctgctctggacctctcatttctcttcattggtttatt

SEQ ID NO: 1615 - DNA, 50 bp, Homo sapiens
atctatccttgccagccttgggcatcacatttaccagtttaatagattgt

SEQ ID NO: 1616 - DNA, 50 bp, Homo sapiens
gccctgatctggagttacctgaggccatagctgccctattcacttctaag

SEQ ID NO: 1617 - DNA, 50 bp, Homo sapiens
cttgaccaaacccacagcctgtctcttctcttgtttagttacttacggca

SEQ ID NO: 1618 - DNA, 50 bp, Homo sapiens
ccttagaagaggaagcaaaggcagattcagggaccaaaaggattaatgat

SEQ ID NO: 1619 - DNA, 50 bp, Homo sapiens
atgtgtcaaccaccatttcagctattaaaaactcctgttatctccttgtt

SEQ ID NO: 1620 - DNA, 50 bp, Homo sapiens
agccaccagagccttcctctctttgtaccacagtttcttctgtaaatcca

SEQ ID NO: 1621 - DNA, 50 bp, Homo sapiens
acatgaaatatagttgcatatatggacaccgacttgggaggacaggtcct

SEQ ID NO: 1622 - DNA, 50 bp, Homo sapiens
ctttccagcctcctgctgggctctctcttcctaccctccttccacatgta

SEQ ID NO: 1623 - DNA, 50 bp, Homo sapiens
agatagccagcctagaggtatggctgtaactatctctgtgaagtgtgaga

SEQ ID NO: 1624 - DNA, 50 bp, Homo sapiens
tggcatcctcaggggttgtgatccagctccatatattgtttaccttcaaa

SEQ ID NO: 1625 - DNA, 50 bp, Homo sapiens
catgaggagagtgctagttcatgtgttctccattcttgtgagcatcctaa

SEQ ID NO: 1626 - DNA, 50 bp, Homo sapiens
cagcaaatccatctgaactgtggaggagaagctctctttactgagggtgc

SEQ ID NO: 1627 - DNA, 50 bp, Homo sapiens
tcagcataaactggaatgtagtgtcagaggatactgtggcttgttttgtt

SEQ ID NO: 1628 - DNA, 50 bp, Homo sapiens
tggtgaaacaaaaccagtcattagaaatggtctgtgcttttattttccca

SEQ ID NO: 1629 - DNA, 50 bp, Homo sapiens
actatgctttattggtcccatgttttgtgcaattttaaagagatggcttt

SEQ ID NO: 1630 - DNA, 50 bp, Homo sapiens
aaagatgaactatttggtctcattgaagccaacacagaacttgctgctgt

SEQ ID NO: 1631 - DNA, 50 bp, Homo sapiens
ggagcccctctttctcccatgctgcacttactccttttgctaataaaagt

SEQ ID NO: 1632 - DNA, 50 bp, Homo sapiens
ccttccatgtcccaccccactcccaccaaaaagtacaaaatcaggatgtt

SEQ ID NO: 1633 - DNA, 50 bp, Homo sapiens
tgatggtaaccataatggaagagattctggctagtgtctatcagaggtga

SEQ ID NO: 1634 - DNA, 50 bp, Homo sapiens
gtcctggtggtatcttcaatagccactaaccctgcctggtacagtatggg

SEQ ID NO: 1635 - DNA, 50 bp, Homo sapiens
cccagctctgctgcccttgttttgctgcatgttaaataaaaccattttca

SEQ ID NO: 1636 - DNA, 50 bp, Homo sapiens
cccacactgctacacttctgatcccctttggttttactacccaaatctaa

SEQ ID NO: 1637 - DNA, 50 bp, Homo sapiens
ctgtaatacctcctcctaaccaagccggatatggtatggcaagttaccaa

SEQ ID NO: 1638 - DNA, 50 bp, Homo sapiens
cccttgtaagggaattctggggcagctatggtttgagtatgcagtttgca

SEQ ID NO: 1639 - DNA, 50 bp, Homo sapiens
acaatctctgtccagcacctcttggttaaataatgtatgctgtgagacat

SEQ ID NO: 1640 - DNA, 50 bp, Homo sapiens
acagggcctcagcaagggagccatacatttttgtaacattttgatatgtt

SEQ ID NO: 1641 - DNA, 50 bp, Homo sapiens
ttgactgtcgatggattgtggtgtggtgtatctgaaggctattgaatgca

SEQ ID NO: 1642 - DNA, 50 bp, Homo sapiens
ttctgttccaaacaagtattctgtagatccaaatggattaccagtgtgct

SEQ ID NO: 1643 - DNA, 50 bp, Homo sapiens
atcttcagaatcagttaggttcctcactgcaagaaataaaatgtcaggca

SEQ ID NO: 1644 - DNA, 50 bp, Homo sapiens
tgaaccttactgcaaaaacttgtgatgtaagaaatttgtatggtgtggca

SEQ ID NO: 1645 - DNA, 50 bp, Homo sapiens
gctgtctcaagggtatccgtacctcaatgtcagttacattcagcagaaaa

SEQ ID NO: 1646 - DNA, 50 bp, Homo sapiens
ttggtcagatttagaagcattcatgctcacaagttttgggaaagtgaaaa

SEQ ID NO: 1647 - DNA, 50 bp, Homo sapiens
ccctaaaggcaagaagaaaaagtaaaagaccttggctcatagaaagtcac

SEQ ID NO: 1648 - DNA, 50 bp, Homo sapiens
gtgtgtgcatggaagatgcctgggctgtctttgctatatgtaaatagagc

SEQ ID NO: 1649 - DNA, 50 bp, Homo sapiens
gccttggctttatttgcaggctactaaagctgcttttactttgtaacttt

SEQ ID NO: 1650 - DNA, 50 bp, Homo sapiens
acagtttggttacaggacttctgtgcattgtaaacataaacagcatggaa

SEQ ID NO: 1651 - DNA, 50 bp, Homo sapiens
tgtgaaagtgtggaatggaagaaatgtcgatcctgttgtaactgattgtg

SEQ ID NO: 1652 - DNA, 50 bp, Homo sapiens
acaaccaaccagtttcttttctagccaatcatctctgaagagttgctgtt

SEQ ID NO: 1653 - DNA, 50 bp, Homo sapiens
gaactccctgattctataccctcttccttctttctgcaaggcagaggaat

SEQ ID NO: 1654 - DNA, 50 bp, Homo sapiens
caccctcagctccaccctcagcagatgataatatcaagacacctgccgag

SEQ ID NO: 1655 - DNA, 50 bp, Homo sapiens
ttggccctcaggtttactgtgtaaatctgcatttttggtggtaaatccct

SEQ ID NO: 1656 - DNA, 50 bp, Homo sapiens
gcatttccatagcactgaagtaccagtttccattcctgggctgagattgt

SEQ ID NO: 1657 - DNA, 50 bp, Homo sapiens
ctccttttaacgtgttattgacaaacctccccaaaagaatatgcaattgt

SEQ ID NO: 1658 - DNA, 50 bp, Homo sapiens
aacattcagttgagaccatatgcattttctgtgctgtttgtacttgaggt

SEQ ID NO: 1659 - DNA, 50 bp, Homo sapiens
ttaaccctcagagaactctgcattttagggtacttgaggctgacttaact

SEQ ID NO: 1660 - DNA, 50 bp, Homo sapiens
agcgacctcttctctagtccggtgttacgaacagaagttctgagttgtgc

SEQ ID NO: 1661 - DNA, 50 bp, Homo sapiens
taaatgtcggtccaggccctgtgcaccttaccccagagacagactctttt

SEQ ID NO: 1662 - DNA, 50 bp, Homo sapiens
ataaggctgtaaaatgagaattctgccccctcacctcttaccccagtact

SEQ ID NO: 1663 - DNA, 50 bp, Homo sapiens
aaaagtcggggatcggggcaagagaggctgagtacggatgggaaactatt

SEQ ID NO: 1664 - DNA, 50 bp, Homo sapiens
gagcacccagagggatttttcagtgggaagcattacactttgctaaatca

SEQ ID NO: 1665 - DNA, 50 bp, Homo sapiens
tgattaggtgacgagttgacattgagattgtccttttcccctgatcaaaa

SEQ ID NO: 1666 - DNA, 50 bp, Homo sapiens
tgtatgtatgggagtgaggagtttcagggccattgcaaacatagctgtgc

SEQ ID NO: 1667 - DNA, 50 bp, Homo sapiens
acagagttatccactttacaacggagacacagttctggaacattgaaact

SEQ ID NO: 1668 - DNA, 50 bp, Homo sapiens
atacgggacaataaaatctgccttttgctctggagggagatactacctct

SEQ ID NO: 1669 - DNA, 50 bp, Homo sapiens
gggcaaacaactttaggaatactagttactcacttaacatggagggcggg

SEQ ID NO: 1670 - DNA, 50 bp, Homo sapiens
aaaggccgcgcagattgtttaattctggaaagtcaatccccggatttagc

SEQ ID NO: 1671 - DNA, 50 bp, Homo sapiens
gggactccatgggaatatttgcccagtaatggtaaggaaatctttcgggt

SEQ ID NO: 1672 - DNA, 50 bp, Homo sapiens
ccagaaaggtgatgaatgaataggactgagagtcacagtgaatgtggcat

SEQ ID NO: 1673 - DNA, 50 bp, Homo sapiens
tcccaaggttgttagtgactgataagcttccaaactacagtacagttttt

SEQ ID NO: 1674 - DNA, 50 bp, Homo sapiens
gttttcttgtagttgcgggtccctcgcgaaagttcattcatggccccact

SEQ ID NO: 1675 - DNA, 50 bp, Homo sapiens
catggggctctcttgtgtacttattgtttaaggtttcctcaaactgtgat

SEQ ID NO: 1676 - DNA, 50 bp, Homo sapiens
acaaattgaaatgtctgtactgatcctcaaccaataaaatctcagccgaa

SEQ ID NO: 1677 - DNA, 50 bp, Homo sapiens
tgcaggagacattggtattctgggcagcttcctaatatgctttacaatct

SEQ ID NO: 1678 - DNA, 50 bp, Homo sapiens; identical to SEQ ID NO: 33

SEQ ID NO: 1679 - DNA, 50 bp, Homo sapiens
ggcattgttagtttagtgtgtgtgcagagtccatttcccacatctttcct

SEQ ID NO: 1680 - DNA, 50 bp, Homo sapiens
gactgcaatgctggtggggaaagacttaaaagtggattaaagacctgcgt

SEQ ID NO: 1681 - DNA, 50 bp, Homo sapiens
gctttccttctccaggaatactgaacatgggagctcttgaaatatgtagt

SEQ ID NO: 1682 - DNA, 50 bp, Homo sapiens
tgggaatcaagatttaatcctagagatttggtgtacaattcaggctttgg

SEQ ID NO: 1683 - DNA, 50 bp, Homo sapiens
gcagtagtgtggactagaacaacccaaatagcatctagaaagccatgagt

SEQ ID NO: 1684 - DNA, 50 bp, Homo sapiens
tgtgtaatgtacctgtcagtgcctcctttattaaggggttctttgagaat

SEQ ID NO: 1685 - DNA, 50 bp, Homo sapiens
ccactgtcactgtttctctgctgttgcaaatacatggataacacatttga

SEQ ID NO: 1686 - DNA, 50 bp, Homo sapiens
agtttgccctggatgtcatattggcagttggaggacacagtttctattgt

SEQ ID NO: 1687 - DNA, 50 bp, Homo sapiens
ccaagttccacattccttctagcgtgccttacatcaggtactttgtcagc

SEQ ID NO: 1688 - DNA, 50 bp, Homo sapiens
agctgtctcctgttttgtaagctttcagtgcaacatttcttggttccaat

SEQ ID NO: 1689 - DNA, 50 bp, Homo sapiens
tgcatgttggggtttcctttaccttttctataagttgtaccaaaacatcc

SEQ ID NO: 1690 - DNA, 50 bp, Homo sapiens
gggtttgtgctatacactgggatgtctaattgcagcaataaagcctttct

SEQ ID NO: 1691 - DNA, 50 bp, Homo sapiens
gccacacttattcttttcagtaacctgctagtgcacaggctgtactttag

SEQ ID NO: 1692 - DNA, 50 bp, Homo sapiens
cagtcgaaggctttaactttgcacacttgggatcacagttgcgtcattgt

SEQ ID NO: 1693 - DNA, 50 bp, Homo sapiens
ttccctttccccagcatcactccccaaggaagagccaatgttttccaccc

SEQ ID NO: 1694 - DNA, 50 bp, Homo sapiens
agccataatgtaaactgcctcaaattggactttgggcataaaagaacttt

SEQ ID NO: 1695 - DNA, 50 bp, Homo sapiens
ttgcttttactagtcttagctctacgatttaaatccatgtgtccaagggg

SEQ ID NO: 1696 - DNA, 50 bp, Homo sapiens
cacacctgcacactcacggctgaaatctccctaacccagggggaccttag

SEQ ID NO: 1697 - DNA, 50 bp, Homo sapiens
agctgtaacgttcgcgttaggaaagatggtgtttattccagtttgcattt

SEQ ID NO: 1698 - DNA, 50 bp, Homo sapiens
aggggttccactagtgtctgctttcctttattattgcactgtgtgaggtt

SEQ ID NO: 1699 - DNA, 50 bp, Homo sapiens
catcctcaggtggtcaggcgtagatcaccagaataaacccagcttccctc

SEQ ID NO: 1700 - DNA, 50 bp, Homo sapiens
acacacaacgtgaaaaataggaacaggaacaaaaagaagaccaatgactc

SEQ ID NO: 1701 - DNA, 50 bp, Homo sapiens
tttagagtcttccattttgttggaattagatcctccccttcaaatgctgt

SEQ ID NO: 1702 - DNA, 50 bp, Homo sapiens
ctaatttcagtgcttgtgcttggttgttcagggccatttcaggtttgggt

SEQ ID NO: 1703 - DNA, 50 bp, Homo sapiens; identical to SEQ ID NO: 206

SEQ ID NO: 1704 - DNA, 50 bp, Homo sapiens; identical to SEQ ID NO: 818

SEQ ID NO: 1705 - DNA, 50 bp, Homo sapiens
aggtggtgttcagtgtcagacctcttaatggccagtgaataacactcact

SEQ ID NO: 1706 - DNA, 50 bp, Homo sapiens
gggggtagtttgtggcaggacaagagaaggcattgagctttttctttcat

SEQ ID NO: 1707 - DNA, 50 bp, Homo sapiens
tcgttaagagagcaacattttacccacacacagataaagttttcccttga

SEQ ID NO: 1708 - DNA, 50 bp, Homo sapiens; identical to SEQ ID NO: 86

SEQ ID NO: 1709 - DNA, 50 bp, Homo sapiens
aaacaaggtaggaatgaggctagacctttaacttccctaaggcatacttt

SEQ ID NO: 1710 - DNA, 50 bp, Homo sapiens
ttccccatatccaagtaccaatgctgttgtaaacaacgtgtatagtgcct

SEQ ID NO: 1711 - DNA, 50 bp, Homo sapiens
tgagcctttcacacctgtgctggcgctggaaaattatttgtgctcagctg

SEQ ID NO: 1712 - DNA, 50 bp, Homo sapiens
tgggattgtactataccagtaagtgccacttctgtgtctttctaatggaa

SEQ ID NO: 1713 - DNA, 50 bp, Homo sapiens
tttttcctcacaggagcggaagaactagggggagcaggagctgcaatgcg

SEQ ID NO: 1714 - DNA, 50 bp, Homo sapiens
tctacccatttcctgaggcctgtggaaataaacctttatgtacttaaagt

SEQ ID NO: 1715 - DNA, 50 bp, Homo sapiens
gtgtccgttatgagtgccaaaaatctgtcttgaaggcagctacactttga

SEQ ID NO: 1716 - DNA, 50 bp, Homo sapiens
ctgtgcaatgctacatgtacgtggacttatatcagaccagtgtggatctt

SEQ ID NO: 1717 - DNA, 50 bp, Homo sapiens
agtcccctgtcctggtcatctatcaagataacaagcggccctcagggatc

SEQ ID NO: 1718 - DNA, 50 bp, Homo sapiens
gggtctatgtgaaaatgcccccaacagagccagaatgtgaaaagcaattt

SEQ ID NO: 1719 - DNA, 50 bp, Homo sapiens
cttgccttaagctaccagattgcttttgccaccattggccatactgtgtg

SEQ ID NO: 1720 - DNA, 50 bp, Homo sapiens
cccctgccagagggagttcttcttttgtgagagacactgtaaacgacaca

SEQ ID NO: 1721 - DNA, 50 bp, Homo sapiens
tgcagccactattgttagtctcttgattcataatgacttaagcacacttg

SEQ ID NO: 1722 - DNA, 50 bp, Homo sapiens
tgactattactgtcaggcgtgggacaccaacactgcggtattcggcggag

SEQ ID NO: 1723 - DNA, 50 bp, Homo sapiens
tttgagacgcaataccaatacttaggattttggtcttggtgtttgtatga

SEQ ID NO: 1724 - DNA, 50 bp, Homo sapiens
tccttccagggcttctttgtgtctgtgttctactgtttcctcaatagtga

SEQ ID NO: 1725 - DNA, 50 bp, Homo sapiens
ccatgtccatccccacctccccaacccgtgtcagctttcacagcatcaag

SEQ ID NO: 1726 - DNA, 50 bp, Homo sapiens
tgccctcaagtaaaagaaaagccgaaagggttaatcatatttgaaaacca

SEQ ID NO: 1727 - DNA, 50 bp, Homo sapiens
atgctacttgggagaaaactctcactaactgtctcaccgggtttcaaagc

SEQ ID NO: 1728 - DNA, 50 bp, Homo sapiens
ggactttgcgaatatcagagacctcagactcttcacagggtcaggactca

SEQ ID NO: 1729 - DNA, 50 bp, Homo sapiens
agctccctgcaagtcacatttcccagtgaaacactgaacttatcagaaaa

SEQ ID NO: 1730 - DNA, 50 bp, Homo sapiens
ttccttcaggatgatctagagcagcatggagctgttggtagaatattagt

SEQ ID NO: 1731 - DNA, 50 bp, Homo sapiens
ggggaggaaggaaggacattaaattctttccctggtaatgaaaagagccc

SEQ ID NO: 1732 - DNA, 50 bp, Homo sapiens
gccttgtacataatactattccatccacacagtttccaccctcacctgcc

SEQ ID NO: 1733 - DNA, 50 bp, Homo sapiens
agcaagatagccaaatgtgacatcaagctccattgtttcggaaatccagg

SEQ ID NO: 1734 - DNA, 50 bp, Homo sapiens
gccgagtgaggtaaccaggtggcatctaccccatgttttataaggaattt

SEQ ID NO: 1735 - DNA, 50 bp, Homo sapiens
ttctttccatttgctatcatgtcagtgaacgccaggagtgctttctttgc

SEQ ID NO: 1736 - DNA, 50 bp, Homo sapiens
tgaatttacttcctcccaagagtttggactgcccgtcagattgtttctgc

SEQ ID NO: 1737 - DNA, 50 bp, Homo sapiens
accctcatttccagggggagcctcaggccccgagataaatgtgctccatg

SEQ ID NO: 1738 - DNA, 50 bp, Homo sapiens
ttctctgagggctgggggttgggggagtcagcatgattatattttaatgt

SEQ ID NO: 1739 - DNA, 50 bp, Homo sapiens
acttggctgtaatcagttatgccgtataggatgtcagacaataccactgg

SEQ ID NO: 1740 - DNA, 50 bp, Homo sapiens
tggagctcagtaacataactgcttcttggagctttggaatattttatcct

SEQ ID NO: 1741 - DNA, 50 bp, Homo sapiens
aaatttcacaagcaatactttggaccactggggttcaggccccaagaaat

SEQ ID NO: 1742 - DNA, 50 bp, Homo sapiens
acacacaaaacagcaaacttcaggtaactattttggattgcaaacaggat

SEQ ID NO: 1743 - DNA, 50 bp, Homo sapiens
tcttgccttaattaacattccctgtgacctagttggtgcagtggcttgaa

SEQ ID NO: 1744 - DNA, 50 bp, Homo sapiens
acttgcagttgtgtggaaaactgttttgtaatgaaagatcttcattgggg

SEQ ID NO: 1745 - DNA, 50 bp, Homo sapiens
tgtgatctctactactgttgattttgccctcggagcaaactgaataaagc

SEQ ID NO: 1746 - DNA, 50 bp, Homo sapiens
taggaaatgtttgacatctgaagctctcttcacactcccgtggcactcct

SEQ ID NO: 1747 - DNA, 50 bp, Homo sapiens
cgtcccctctccccttggttctgcactgttgccaataaaaagctcttaaa

SEQ ID NO: 1748 - DNA, 50 bp, Homo sapiens
gggagtgttgtgactgaaatgcttgaaaccaaagcttcagataaacttgc

SEQ ID NO: 1749 - DNA, 50 bp, Homo sapiens
aggggacagaaatcaggtattggcagtttttccattttcatttgtgtgtg

SEQ ID NO: 1750 - DNA, 50 bp, Homo sapiens
agccgcccagctacctaattcctcagtaacatcgatctaaaatctccatg

SEQ ID NO: 1751 - DNA, 50 bp, Homo sapiens
acatgcaagtacatgtttttaatgttgtctgtcttctgtgctgttcctgt

SEQ ID NO: 1752 - DNA, 50 bp, Homo sapiens
cctgtgtgggactgagatgcaggatttcttcacacctctcctttgtgact

SEQ ID NO: 1753 - DNA, 50 bp, Homo sapiens
ggcatctgaatgtgtctgcgttcctgttagcataatgtgaggaggtggag

SEQ ID NO: 1754 - DNA, 50 bp, Homo sapiens
ctgagagcccaaactgctgtcccaaacatgcacttccttgcttaaggtat

SEQ ID NO: 1755 - DNA, 50 bp, Homo sapiens
aagctccctggagccctgttggcagctctagcttttgcagtcgtgtaatg

SEQ ID NO: 1756 - DNA, 50 bp, Homo sapiens
agccctctttctctccacccaatgctgctttctcctgttcatcctgatgg

SEQ ID NO: 1757 - DNA, 50 bp, Homo sapiens
tccacaggggtggtgtcaaatgctattgaaattgtgttgaattgtatgct

SEQ ID NO: 1758 - DNA, 50 bp, Homo sapiens; identical to SEQ ID NO: 1465

SEQ ID NO: 1759 - DNA, 50 bp, Homo sapiens
gacttccacagcagcagaacaagtgcctcctggactgttcacggcagacc

SEQ ID NO: 1760 - DNA, 50 bp, Homo sapiens
tatccccagctcaggtggtgagtcctcctgtccagcctgcatcaataaaa

SEQ ID NO: 1761 - DNA, 50 bp, Homo sapiens
ctgggttttgtggtcatctattctagcagggaacactaaaggtggaaata

SEQ ID NO: 1762 - DNA, 50 bp, Homo sapiens
agctatggaatcaattcaatttggactggtgtgctctctttaaatcaagt

SEQ ID NO: 1763 - DNA, 50 bp, Homo sapiens
tggctcaagtagaaaagcagtcccattcatattaagacagtgtacaaaac

SEQ ID NO: 1764 - DNA, 50 bp, Homo sapiens
agctcttgaaagcagctttgagttagaagtatgtgtgttacaccctcaca

SEQ ID NO: 1765 - DNA, 50 bp, Homo sapiens
aaccggatatatacatagcatgacatttctttgtgctttggcttacttgt

SEQ ID NO: 1766 - DNA, 50 bp, Homo sapiens; identical to SEQ ID NO: 270

SEQ ID NO: 1767 - DNA, 50 bp, Homo sapiens
aaagttgatactgtgggatttttgtgaacagcctgatgtttgggaccttt

SEQ ID NO: 1768 - DNA, 50 bp, Homo sapiens
cttccttagctcctgttcttggcctgaagcctcacagctttgatggcagt

SEQ ID NO: 1769 - DNA, 50 bp, Homo sapiens
tttgtgcttccctttacctaaactgtcctgcctcccatgcatctgtaccc

SEQ ID NO: 1770 - DNA, 50 bp, Homo sapiens; identical to SEQ ID NO: 1769

SEQ ID NO: 1771 - DNA, 50 bp, Homo sapiens
cttgtggcttcctcagctcctgcccttggcctgaagtcccagcattgatg

SEQ ID NO: 1772 - DNA, 50 bp, Homo sapiens
atttgtttgcatccctcccccacaccctggtgttttaaaatgaagaaaaa

SEQ ID NO: 1773 - DNA, 50 bp, Homo sapiens
catccgacataatcctacaggtgctgtgttattcatggggcagataaaca

SEQ ID NO: 1774 - DNA, 50 bp, Homo sapiens
agtggggtggggagcatgttcatttgtacctcgagttttaaactggttcc

SEQ ID NO: 1775 - DNA, 50 bp, Homo sapiens
cctaaaccgtatggcctcccgtgcatctgtattcaccctgtatgacaaac

SEQ ID NO: 1776 - DNA, 50 bp, Homo sapiens
tttcatctcaggcctccctcaaccccaccacttcttttataactagtcct

SEQ ID NO: 1777 - DNA, 50 bp, Homo sapiens
gcatggcttaacctggtgataaaagcagttattaaaagtctacgttttcc

SEQ ID NO: 1778 - DNA, 50 bp, Homo sapiens
agcttccgccgtctcaacccctcacaggagcttactggcaaacatgaaaa

SEQ ID NO: 1779 - DNA, 50 bp, Homo sapiens
tctcctccacctcaactccgtgcttaaccaaagaagctgtactccggggg

SEQ ID NO: 1780 - DNA, 50 bp, Homo sapiens
acccaagggacctggatttggtgtacaagcaggcctttaatttatattga

SEQ ID NO: 1781 - DNA, 50 bp, Homo sapiens
agctcctcttcctggcttcttactgaaaggttaccctgtaacatgcaatt

SEQ ID NO: 1782 - DNA, 50 bp, Homo sapiens; identical to SEQ ID NO: 194

SEQ ID NO: 1783 - DNA, 50 bp, Homo sapiens
ccaccccaaccttctggtggggagaaataaacggtttagagacagctctg

SEQ ID NO: 1784 - DNA, 50 bp, Homo sapiens
gccaagggccaagagaatatccgaactttaatttcaggaattgaatgggt

SEQ ID NO: 1785 - DNA, 50 bp, Homo sapiens; identical to SEQ ID NO: 150

SEQ ID NO: 1786 - DNA, 50 bp, Homo sapiens
ccggttgttaaaactggtttagcacaatttatattttccctctcttgcct

SEQ ID NO: 1787 - DNA, 50 bp, Homo sapiens
attaaagcaccaaattcatgtacagcatgcatcacggatcaatagactgt

SEQ ID NO: 1788 - DNA, 50 bp, Homo sapiens
tagccgtactttgctaactgtgctcctcacttcctcttcttcattgcagt

SEQ ID NO: 1789 - DNA, 50 bp, Homo sapiens
aggctaagctgccggttcttaaatccatcctgctaagttaatgttgggta

SEQ ID NO: 1790 - DNA, 50 bp, Homo sapiens
aatatatgcatccctggtgaaggatcttgcctgcatgaaacatgttctca

SEQ ID NO: 1791 - DNA, 50 bp, Homo sapiens
acctgggcattcttgtttcattcaattccacctgcaatcaagtcctacaa

SEQ ID NO: 1792 - DNA, 50 bp, Homo sapiens
ctccctcacagcacagagaagacaaaattagcaaaaccccactacacagt

SEQ ID NO: 1793 - DNA, 50 bp, Homo sapiens
gttcagtggcactcaacatgagtcaagagcatcctgcttctaccatgtgg

SEQ ID NO: 1794 - DNA, 50 bp, Homo sapiens
cttgagctagaagtctccaaggaggtcgggatggggcttgtagcagaagg

SEQ ID NO: 1795 - DNA, 50 bp, Homo sapiens
ctcccaactcctccctatcctaaaggcccactggcattaaagtgctgtat

SEQ ID NO: 1796 - DNA, 50 bp, Homo sapiens
tcggtcctctttccagtggatcataagacaatggaccctttttgttatga

SEQ ID NO: 1797 - DNA, 50 bp, Homo sapiens
aacacacagtgtttatgttggaatcttttggaactcctttgatctcactg

SEQ ID NO: 1798 - DNA, 50 bp, Homo sapiens
ggggctctttccctcatgtatacttcaagtaagatcaagaatcttttgtg

SEQ ID NO: 1799 - DNA, 50 bp, Homo sapiens
tcatcctctgtgtggctcatgtttttgcttttcaacacacaaagcacaaa

SEQ ID NO: 1800 - DNA, 50 bp, Homo sapiens
tggatgattgggactttaaaacgaccctctttcaggtggattcagagacc

SEQ ID NO: 1801 - DNA, 50 bp, Homo sapiens
tgtagcttctgaaaggtgctttctccatttatttaaaaactacccatgca

SEQ ID NO: 1802 - DNA, 50 bp, Homo sapiens
tgtagcaacatgagaaacgcttatgttacaggttacatgagagcaatcat

SEQ ID NO: 1803 - DNA, 50 bp, Homo sapiens
ctgatggctgtgaccctgcttcctgcactgacccagagcctctgcctgtg

SEQ ID NO: 1804 - DNA, 50 bp, Homo sapiens
tgtgtgttgatcccaagacaatgaaagtttgcactgtatgctggacggca

SEQ ID NO: 1805 - DNA, 50 bp, Homo sapiens
ctctcctcagactgctcaagagaagcacatgaaaaccattacctgacttt

SEQ ID NO: 1806 - DNA, 50 bp, Homo sapiens
gccagtaagatcaatgtgacggcagggaaatgtatgtgtgtctattttgt

SEQ ID NO: 1807 - DNA, 50 bp, Homo sapiens
gcaacaatgaagttaatggataccctctgcctttggctcagaaatgttat

SEQ ID NO: 1808 - DNA, 50 bp, Homo sapiens
tgtctttcggttatcaagtgtttctgcatggtaatgtcatgtaaatgctg

SEQ ID NO: 1809 - DNA, 50 bp, Homo sapiens
tatcatggggagtaataggaccagagcggtatctctggcaccacactagc

SEQ ID NO: 1810 - DNA, 50 bp, Homo sapiens
tgatcttggctgtatttaatggcataggctgacttttgcagatggaggaa

SEQ ID NO: 1811 - DNA, 50 bp, Homo sapiens
agtactgagaaaaatcccttcagctctaagaacactgaaaaatccaccga

SEQ ID NO: 1812 - DNA, 50 bp, Homo sapiens
actttgcacacatttgcatccacatattagggaaggaataagtagctgca

SEQ ID NO: 1813 - DNA, 50 bp, Homo sapiens
atgcagtgtttccctctgtgttagagcagagaggtttcgatatttattga

SEQ ID NO: 1814 - DNA, 50 bp, Homo sapiens
tgctgaagtttcccttagacattttatgtcttgcttgtagggcataatgc

SEQ ID NO: 1815 - DNA, 50 bp, Homo sapiens
cactggaccattgtcacaaccctctgtttctctttgactaagtgccctgg

SEQ ID NO: 1816 - DNA, 50 bp, Homo sapiens
aagtgttactgtggcttcaaagaagctattgattctgaagtagtgggttt

SEQ ID NO: 1817 - DNA, 50 bp, Homo sapiens
gctgcttatatatttaataataaaagaagtgcacaagctgccgttgacgt

SEQ ID NO: 1818 - DNA, 50 bp, Homo sapiens
aacaaacatttggttttgttcagaccttatttccactctggtggataagt

SEQ ID NO: 1819 - DNA, 50 bp, Homo sapiens
gagagagggcacgagaacccaaaggaatagagattctccaggaatttcct

SEQ ID NO: 1820 - DNA, 50 bp, Homo sapiens
ttcccagcatcagccttagaacaagaaccttaccttcaaggagcaagtga

SEQ ID NO: 1821 - DNA, 50 bp, Homo sapiens
ctgtccagctccctctccccaagaaacaacatgaatgagcaacttcagag

SEQ ID NO: 1822 - DNA, 50 bp, Homo sapiens
ctgtaacgacgagagcggcgaggatgtcgaggttccctatgtccgataca

SEQ ID NO: 1823 - DNA, 50 bp, Homo sapiens
acctagtcatcaggacactgagccagggctgcaaccactccatgagtttg

SEQ ID NO: 1824 - DNA, 50 bp, Homo sapiens
ccccaaccctctgggctcttggatttcagagtgaaaacttgatggcattg

SEQ ID NO: 1825 - DNA, 50 bp, Homo sapiens
tcaattcctctgggaatgttacattgtttgtctgtcttcatagcagattt

SEQ ID NO: 1826 - DNA, 50 bp, Homo sapiens
accagtttctttcccttctagatcaccctgttctgaagccagcctctctc

SEQ ID NO: 1827 - DNA, 50 bp, Homo sapiens
ctacctgaacccctcttgccactgccttctaccttgtttgaaacctgaat

SEQ ID NO: 1828 - DNA, 50 bp, Homo sapiens
aactcgagaccttttcaacttggcttcctttcttggttcataaatgaatt

SEQ ID NO: 1829 - DNA, 50 bp, Homo sapiens
agctgctgctggatcacagctgctttctgttgtcattgctgttgtccctc

SEQ ID NO: 1830 - DNA, 50 bp, Homo sapiens; identical to SEQ ID NO: 110

SEQ ID NO: 1831 - DNA, 50 bp, Homo sapiens
atccagccccacccaatggccttttgtgcttgtttcctataacttcagta

SEQ ID NO: 1832 - DNA, 50 bp, Homo sapiens
ccttctttgtatataggcttctcaccgcgaccaataaacagctcccagtt

SEQ ID NO: 1833 - DNA, 50 bp, Homo sapiens
aaaacgatgaaggtatgctgtcatggtcctttctggaagtttctggtgcc

SEQ ID NO: 1834 - DNA, 50 bp, Homo sapiens
aatgcgaaattattggttggtgtgaagaaagccagacaacttctgtttct

SEQ ID NO: 1835 - DNA, 50 bp, Homo sapiens
ctgtggctcgtttgagggattggggtggacctggggtttattttcagtaa

SEQ ID NO: 1836 - DNA, 50 bp, Homo sapiens
gcttccccaccccagtttttgttgcttgaaaatattgttgtcccggattt

SEQ ID NO: 1837 - DNA, 50 bp, Homo sapiens
tggactgttttgttgggcagtgcctgataagcttcaaagctgctttattc

SEQ ID NO: 1838 - DNA, 50 bp, Homo sapiens
cctgccgtgcccacctaactgtccagatgaggtttatcagcttatgagaa

SEQ ID NO: 1839 - DNA, 50 bp, Homo sapiens
cgagctgagaagcggtcatgagcacctggggattttagtaagtgtgtctt

SEQ ID NO: 1840 - DNA, 50 bp, Homo sapiens
accatccaatcggacaagctttcagaaccttattgaaggatttgaagcac

SEQ ID NO: 1841 - DNA, 50 bp, Homo sapiens
tgctgatgaacctgcagaaaaggctgatgaaccaatggaacattaagtga

SEQ ID NO: 1842 - DNA, 50 bp, Homo sapiens
tcttatgcacacggtgatttcatgttatatatgcaaagtaggcaactgtt

SEQ ID NO: 1843 - DNA, 50 bp, Homo sapiens
aacataggagtggattcctgccccaaccaaaccgcattcgtgtggatttt

SEQ ID NO: 1844 - DNA, 50 bp, Homo sapiens
aataaatttgcaaaaccaagatcacagtacaccatatgcactctggtacc

SEQ ID NO: 1845 - DNA, 50 bp, Homo sapiens
aaatgacctcatgttgtggtttaaacagcaactgcacccactagcacagc

SEQ ID NO: 1846 - DNA, 50 bp, Homo sapiens
tgtgcagtagaaacaaaagtaggctacagtctgtgccatgttgatgtaca

SEQ ID NO: 1847 - DNA, 50 bp, Homo sapiens
ctgtttattctgggaaatgttttaatgccagggcctgctgagttgcttct

SEQ ID NO: 1848 - DNA, 50 bp, Homo sapiens
ccttaagaccagttcatagttaatacaggtttacagttcatgcctgtggt

SEQ ID NO: 1849 - DNA, 50 bp, Homo sapiens
tcatcactttggacaggagttaattaagagaatgaccaagctcagttcaa

SEQ ID NO: 1850 - DNA, 50 bp, Homo sapiens
agtctgcctaaataggtagcttaaacttatgtcaaaatgtctgcagcagt

SEQ ID NO: 1851 - DNA, 50 bp, Homo sapiens
ctggcctccagtgccttcccccgtggaataaacggtgtgtcctgagaaac

SEQ ID NO: 1852 - DNA, 50 bp, Homo sapiens
agctaattaagctgcagaacgtgggaaataaagttcgaaacaaaggttaa

SEQ ID NO: 1853 - DNA, 50 bp, Homo sapiens
ggacaggtgtgccgacagaaggaaccagcgtgtatatgagggtatcaaat

SEQ ID NO: 1854 - DNA, 50 bp, Homo sapiens
cccttcgtggggctacacattctcttcctcatattttcatgcacacaagt

SEQ ID NO: 1855 - DNA, 50 bp, Homo sapiens
ttctgcacaggtctctgtttagtaaatacatcactgtataccgatcagga

SEQ ID NO: 1856 - DNA, 50 bp, Homo sapiens
caccctccaccccttccttttgcgcggaccccattacaataaattttaaa

SEQ ID NO: 1857 - DNA, 50 bp, Homo sapiens
catgcagctatttcaaagtgtgttggattaattaggatcatccctttggt

SEQ ID NO: 1858 - DNA, 50 bp, Homo sapiens
tggagaattgtggaaggattgtaacatggaccatccaaatttatggccgt

SEQ ID NO: 1859 - DNA, 50 bp, Homo sapiens
ttcacgggatgcaccaaagtgtgtaccccgtaagcatgaaaccagtgttt

SEQ ID NO: 1860 - DNA, 50 bp, Homo sapiens
tctgtccatcagtgcatgacgtttaaggccacgtatagtcctagctgacg

SEQ ID NO: 1861 - DNA, 50 bp, Homo sapiens
tcctataattatttctgtagcactccacactgatctttggaaacttgccc

SEQ ID NO: 1862 - DNA, 50 bp, Homo sapiens
gggacactggaggctggagctacagttgaaagcactgcatgttaagaggg

SEQ ID NO: 1863 - DNA, 50 bp, Homo sapiens
tgctaccacaactatattatcatgcaaatgctgtattcttctttggtgga

SEQ ID NO: 1864 - DNA, 50 bp, Homo sapiens
gcaacttacgcttggcatcttcagaatgcttttctagcattaagagatgt

SEQ ID NO: 1865 - DNA, 50 bp, Homo sapiens
tttacaagaattgtccatgtgcttccctaggctgagctggcattggtctg

SEQ ID NO: 1866 - DNA, 50 bp, Homo sapiens
aaaacttcccaccctacttttccaagagtgccagttggattctgaatctg

SEQ ID NO: 1867 - DNA, 50 bp, Homo sapiens
tagaccaattctctgatctcgagttgtttttgtttggatacagccctttt

SEQ ID NO: 1868 - DNA, 50 bp, Homo sapiens
aacattctacatagcacaggagcttaagagtggcattatcttctcgcctt

SEQ ID NO: 1869 - DNA, 50 bp, Homo sapiens
agatacgcagacattgtggcatctgggtagaagaatactgtattgtgtgt

SEQ ID NO: 1870 - DNA, 50 bp, Homo sapiens
tttgaccagaagcccttagtaagtacgtgcctgaaactgaaaccatgtgc

SEQ ID NO: 1871 - DNA, 50 bp, Homo sapiens
acacctggcttggagtcagatttagttaacaataatgagcctggagcagt

SEQ ID NO: 1872 - DNA, 50 bp, Homo sapiens
tctaatagcgggttactttcacatacagccctcccccagcagttgaatga

SEQ ID NO: 1873 - DNA, 50 bp, Homo sapiens
ctgaaaagtgctttgctggagtcctgttctctgagctccacagaagacac

SEQ ID NO: 1874 - DNA, 50 bp, Homo sapiens
aagcctaaagtgattcaatagcccaggagcacctgattcctttctgcctg

SEQ ID NO: 1875 - DNA, 50 bp, Homo sapiens
tgggcatggttgaatctgaaaccctccttctgtggcaacttgtactgaaa

SEQ ID NO: 1876 - DNA, 50 bp, Homo sapiens
ggggtggggtggggtgagagtgtgtggagtaaggacattcagaataaata

SEQ ID NO: 1877 - DNA, 50 bp, Homo sapiens
agaagttgtgcgcgtgctttctcagcagcatttttccttcaaaatcatct

SEQ ID NO: 1878 - DNA, 50 bp, Homo sapiens
cttgccagccaggagtgcggacaccatgttcccagctcagtgccaaagag

SEQ ID NO: 1879 - DNA, 50 bp, Homo sapiens
atttggggagagaaaacctttttaagcatggtggggcactcagataggag

SEQ ID NO: 1880 - DNA, 50 bp, Homo sapiens
accctctttcttgtttgtcagcatctgaccatctgtgactataaagctgt

SEQ ID NO: 1881 - DNA, 50 bp, Homo sapiens
tggtcatccaaactcaaacttgagaaaatatcttgctttcaaattgacac

SEQ ID NO: 1882 - DNA, 50 bp, Homo sapiens
accgaatttggcaagaatgaaatggtgtcataaagatgggaggggagggt

SEQ ID NO: 1883 - DNA, 50 bp, Homo sapiens
agcctgtgacattaagcattctcacaattagaaataagaataaaacccat

SEQ ID NO: 1884 - DNA, 50 bp, Homo sapiens
aaaaataaaaacaaatactgtgtttcagaagcgccacctattggggaaaa

SEQ ID NO: 1885 - DNA, 50 bp, Homo sapiens
ttatcacaagctctgttacctttatatacgctgcctcttcaatttggaaa

SEQ ID NO: 1886 - DNA, 50 bp, Homo sapiens
gcagaaaatatcctggcagggaatctggcttaaacatgaaatgctgtaat

SEQ ID NO: 1887 - DNA, 50 bp, Homo sapiens
tgtgtgcataatagctacagtgcatagttgtagacaaagtacattctggg

SEQ ID NO: 1888 - DNA, 50 bp, Homo sapiens
tctcagtgggtggtagcagagggatcaagcagttatttgatttgtgctct

SEQ ID NO: 1889 - DNA, 50 bp, Homo sapiens
gtctatttacggaactcaaatacgtgggcattcaaatgtattacagtggg

SEQ ID NO: 1890 - DNA, 50 bp, Homo sapiens
tgcacttttagaaatgcatatttgccacaaaacctgtattactgaataat

SEQ ID NO: 1891 - DNA, 50 bp, Homo sapiens
gggaggggattaaccaaaggccaccctgactttgtttttgtggacacaca

SEQ ID NO: 1892 - DNA, 50 bp, Homo sapiens
gcctgcccctgtgtattcaccaccaataaatcagaccatgaaacctgaaa

SEQ ID NO: 1893 - DNA, 50 bp, Homo sapiens
aggtgtatttatgttaccgttctgaataaacagaatggaccattgaacca

SEQ ID NO: 1894 - DNA, 50 bp, Homo sapiens
tgtaatgaatttgtcgcaaagacgtaataaaattaactggtggcacggtc

SEQ ID NO: 1895 - DNA, 50 bp, Homo sapiens
tgtcaatggaagttggctgcacttgatgtttgtttgcatgatgtctacct

SEQ ID NO: 1896 - DNA, 50 bp, Homo sapiens
tcgagcacctgtaaacaattttctcaacctatttgatgttcaaataaaga

SEQ ID NO: 1897 - DNA, 50 bp, Homo sapiens
aactttactaagtaatctcacagcatttgccaagtctcccaatatccaat

SEQ ID NO: 1898 - DNA, 50 bp, Homo sapiens
taagatctttaaactgctttatacactgtcacgtggcttcatcagctgtg

SEQ ID NO: 1899 - DNA, 50 bp, Homo sapiens
aaaaccactaccctcagagagagccaaaaatacagaagaggcggagagcg

SEQ ID NO: 1900 - DNA, 50 bp, Homo sapiens
cgagcaagcctgggaactcaggaaaattcacaggacttgggagattctaa

SEQ ID NO: 1901 - DNA, 50 bp, Homo sapiens
ggcttagctacagtgaagttttgcattgcttttgaagacaagaaaagtgc

SEQ ID NO: 1902 - DNA, 50 bp, Homo sapiens
acttcaaaattaccttttcatatccatgatcttgagtccatttgggggat

SEQ ID NO: 1903 - DNA, 50 bp, Homo sapiens
caaacacttttgggccaggatttgagtctctgcatgacatatacttgatt

SEQ ID NO: 1904 - DNA, 50 bp, Homo sapiens
cagactccaccaagcctggtcagcccaaaccaccagaagcccagaataaa

SEQ ID NO: 1905 - DNA, 50 bp, Homo sapiens
agtgcagaatctcataggttgccaataatacactaattcctttctatcct

SEQ ID NO: 1906 - DNA, 50 bp, Homo sapiens
agactgactacattggaagctttgagttgacttctgaccaaaggtggtaa

SEQ ID NO: 1907 - DNA, 50 bp, Homo sapiens; identical to SEQ ID NO: 1761

SEQ ID NO: 1908 - DNA, 50 bp, Homo sapiens
gtggtgagggcagttctgcacccagccaaacacataacaataaaaaccaa

SEQ ID NO: 1909 - DNA, 50 bp, Homo sapiens
tctgtgtcctaaagatgtgttctctataaaatacaaaccaacgtgcctaa

SEQ ID NO: 1910 - DNA, 50 bp, Homo sapiens
ctagtcatagaaatacctcattcgcctgtgggaagagaagggaagcctct

SEQ ID NO: 1911 - DNA, 50 bp, Homo sapiens
agcagcggctggatgtgatatgtctagtttaaccagtccccttgatcttt

SEQ ID NO: 1912 - DNA, 50 bp, Homo sapiens
tattggaggactccctcccagctttggaagggtcatccgcgtgtgtgtgt

SEQ ID NO: 1913 - DNA, 50 bp, Homo sapiens
atacaaagcaaacaaactcaagttatgtcatacctttggatacgaagacc

SEQ ID NO: 1914 - DNA, 50 bp, Homo sapiens; identical to SEQ ID NO: 1575

SEQ ID NO: 1915 - DNA, 50 bp, Homo sapiens; identical to SEQ ID NO: 257

SEQ ID NO: 1916 - DNA, 50 bp, Homo sapiens
gcccaaagaagcaaggaaccaaatttaagactctcgcatcttcccaaccc

SEQ ID NO: 1917 - DNA, 50 bp, Homo sapiens
ccggagtctgggattcatcccgtcatttctttcaataaataattattgga

SEQ ID NO: 1918 - DNA, 50 bp, Homo sapiens
gcaatggcagccttggcaaacgctaaatgaaaatcgtgacaacacttgtg

SEQ ID NO: 1919 - DNA, 50 bp, Homo sapiens
agtgttggtagcacttaagacttatacttgccttctgatagtattccttt

SEQ ID NO: 1920 - DNA, 50 bp, Homo sapiens
aactgaggactgtttgcaattgacataggcaataataagtgatgtgctga

SEQ ID NO: 1921 - DNA, 50 bp, Homo sapiens
gggctcagttctgccttatctaaatcaccagagaccaaacaaggactaat

SEQ ID NO: 1922 - DNA, 50 bp, Homo sapiens; identical to SEQ ID NO: 614

SEQ ID NO: 1923 - DNA, 50 bp, Homo sapiens
tcttggaaacttccattaagtgtgtagattgagcaggtagtaattgcatg

SEQ ID NO: 1924 - DNA, 50 bp, Homo sapiens
actactcagcatggaaacaagatgaaattccatttgtaggtagtgagaca

SEQ ID NO: 1925 - DNA, 50 bp, Homo sapiens
cactaatgatcctgctaccctcttgaagaccagcccggtacctctctccc

SEQ ID NO: 1926 - DNA, 50 bp, Homo sapiens
gtgacctcacttctggcactgtgactactatggctgtttagaactactga

SEQ ID NO: 1927 - DNA, 50 bp, Homo sapiens
aagccttattcttcaactaaaagatgaggattaagagcaagaagttgggg

SEQ ID NO: 1928 - DNA, 50 bp, Homo sapiens
gcactgaatcgtttcatgtaagaatccaaagtggacaccattaacaggtc

SEQ ID NO: 1929 - DNA, 50 bp, Homo sapiens
ggtgctcacattccttaaattaaggagaaatgctggcatagagcagcact

SEQ ID NO: 1930 - DNA, 50 bp, Homo sapiens
cttttgttctctccgtgaaacttacctttccctttttctttctctttttt

SEQ ID NO: 1931 - DNA, 50 bp, Homo sapiens
tggtatgtagagcttagatttccctattgtgacagagccatggtgtgttt

SEQ ID NO: 1932 - DNA, 50 bp, Homo sapiens
tggagataatctagaacacaggcaaaatccttgcttatgacatcacttgt

SEQ ID NO: 1933 - DNA, 50 bp, Homo sapiens
gtgcctctgtgctgtgtatgtgaaccacccatgtgagggaataaacctag

SEQ ID NO: 1934 - DNA, 50 bp, Homo sapiens
tgcaaacggttttgtaagttaacactacactactcacaatggtaggggaa

SEQ ID NO: 1935 - DNA, 50 bp, Homo sapiens
cctgtgcccagcaggaaggaagtcaaataaaccacactgactacctgtgc

SEQ ID NO: 1936 - DNA, 50 bp, Homo sapiens
cccaacaatcccaaggccctttttatacaaaaattctcagttctcttcac

SEQ ID NO: 1937 - DNA, 50 bp, Homo sapiens
tgtctgttttaatcatgtatctggaatagggtcgggaagggtttgtgcta

SEQ ID NO: 1938 - DNA, 50 bp, Homo sapiens
cacgatggtggaaacagtggggaactactgctggaaaaagccctaatagc

SEQ ID NO: 1939 - DNA, 50 bp, Homo sapiens
ccctggaggcactgaagtgcttagtgtacttggagtattggggtctgacc

SEQ ID NO: 1940 - DNA, 50 bp, Homo sapiens
acaagtttacatgataaaaagaaatgtgatttgtcttcccttctttgcac

SEQ ID NO: 1941 - DNA, 50 bp, Homo sapiens
ttgtatgtgaataattctagcgggggacctgggagataattctacgggga

SEQ ID NO: 1942 - DNA, 50 bp, Homo sapiens
atctattctaacgcaaaaccactaactgaagttcagatataatggatggt

SEQ ID NO: 1943 - DNA, 50 bp, Homo sapiens
gtaacggaacatatccagtactcctggttcctaggtgagcaggtgatgcc

SEQ ID NO: 1944 - DNA, 50 bp, Homo sapiens
actaatttgatgtttacaggtggacacacaaggtgcaaatcaatgcgtac

SEQ ID NO: 1945 - DNA, 50 bp, Homo sapiens
tgtgtgttttagtttcatcacctgttatctgtgtttgctgaggagagtgg

SEQ ID NO: 1946 - DNA, 50 bp, Homo sapiens
ttggagctgttccattgggtcctcttggtgtcgtttccctcccaacagag

SEQ ID NO: 1947 - DNA, 50 bp, Homo sapiens
atttgttgctctcagactgtgtaaaacaaaatttattcatgttttctgca

SEQ ID NO: 1948 - DNA, 50 bp, Homo sapiens
ctgaaccattactgtaattggctcttaaggcttgaagtaaccttataggt

SEQ ID NO: 1949 - DNA, 50 bp, Homo sapiens
gctaagctgccggttcttaaatccatcctgctaagttaatgttgggtaga

SEQ ID NO: 1950 - DNA, 50 bp, Homo sapiens
tgtaaccaataaatctgtagtgaccttacctgtattccctgtgctatcct

SEQ ID NO: 1951 - DNA, 50 bp, Homo sapiens; identical to SEQ ID NO: 305

SEQ ID NO: 1952 - DNA, 50 bp, Homo sapiens
atttctcccttatctactgtgatgacttcagaagatacaatggtcccagg

SEQ ID NO: 1953 - DNA, 50 bp, Homo sapiens
tgtctggagggggtttgtgcctgataacgtaataacaccagtggagactt

SEQ ID NO: 1954 - DNA, 50 bp, Homo sapiens
acactgccttctcaactccaaactgactcttaagaagactgcattatatt

SEQ ID NO: 1955 - DNA, 50 bp, Homo sapiens
agatgttccaaatttagaaagcttaaggcggcctacagaaaaaggaaaaa

SEQ ID NO: 1956 - DNA, 50 bp, Homo sapiens
aagtccaactactaaactgggggatattatgaagggccttgagcatctgg

SEQ ID NO: 1957 - DNA, 50 bp, Homo sapiens
atccacctccctcccctagagctattctcctttgggtttcttgctgctgc

SEQ ID NO: 1958 - DNA, 50 bp, Homo sapiens
aaaaggccacagcaatctgtactacaatcaactttattttgaaatcatgt

SEQ ID NO: 1959 - DNA, 50 bp, Homo sapiens
gattagttaccattgaaattggttctgtcataaaacagcatgagtctggt

SEQ ID NO: 1960 - DNA, 50 bp, Homo sapiens
aaaaatacacatcacacccatttaaaagtgatcttgagaaccttttcaaa

SEQ ID NO: 1961 - DNA, 50 bp, Homo sapiens
acagcaacagctattaaatcagcaagttttggagcaaagacaacagcagt

SEQ ID NO: 1962 - DNA, 50 bp, Homo sapiens
tgaccagggcagtgaaaatgaaaccgcattttgggtgccattaaataggg

SEQ ID NO: 1963 - DNA, 50 bp, Homo sapiens
caatttctttattagagggccttattgatgtgttctaagtctttccagaa

SEQ ID NO: 1964 - DNA, 50 bp, Homo sapiens
agagctgaaatgtcaggaacaaaaagaagaacagctgcaggaaggggtgc

SEQ ID NO: 1965 - DNA, 50 bp, Homo sapiens
ggtaataagagcagtagcagcagcatctctgaacatttctctggatttgc

SEQ ID NO: 1966 - DNA, 50 bp, Homo sapiens
agagtttggaaaaagcctgtgaaaggtgtcttctttgacttaatgtcttt

SEQ ID NO: 1967 - DNA, 50 bp, Homo sapiens
gtatggtagattcaaatgaaccactgaaaaggcatttagtttcttgtccc

SEQ ID NO: 1968 - DNA, 50 bp, Homo sapiens; identical to SEQ ID NO: 1762

SEQ ID NO: 1969 - DNA, 50 bp, Homo sapiens
gctcttaagttgtggagagtgcaacagtagcataggaccctaccctctgg

SEQ ID NO: 1970 - DNA, 50 bp, Homo sapiens; identical to SEQ ID NO: 658

SEQ ID NO: 1971 - DNA, 50 bp, Homo sapiens
aaaacagccaaaactccacagtcaatattagtaatttcttgctggttgaa

SEQ ID NO: 1972 - DNA, 50 bp, Homo sapiens
tagcatttgtttaagggtgatagtcaaattatgtattggtggggctgggt

SEQ ID NO: 1973 - DNA, 50 bp, Homo sapiens
gcagatgagacagcaaccattgtagaatttctgaacagatggattacctt

SEQ ID NO: 1974 - DNA, 50 bp, Homo sapiens
tctaatttctgaaatgtgcagctcccatttggccttgtgcggttgtgttc

SEQ ID NO: 1975 - DNA, 50 bp, Homo sapiens
accagagtacgttggaaaacttcttggaaaggctaaagacgatcatgaga

SEQ ID NO: 1976 - DNA, 50 bp, Homo sapiens
tgaggacttttcgaccaattcaaccctttgccccacctttattaaaatct

SEQ ID NO: 1977 - DNA, 50 bp, Homo sapiens
gctggcccataaacaccctgtaggttcttgatatttataataaaattggt

SEQ ID NO: 1978 - DNA, 50 bp, Homo sapiens
cccagggagttgtgtctgtaatcggcctactattcagtggcgagaaataa

SEQ ID NO: 1979 - DNA, 50 bp, Homo sapiens; identical to SEQ ID NO: 1810

SEQ ID NO: 1980 - DNA, 50 bp, Homo sapiens
ttgttgacaactgtgactgtacccaaatggaaagtaactcatttgttaaa

SEQ ID NO: 1981 - DNA, 50 bp, Homo sapiens
gtcaagattgtgttttgaggtttccttcagacagattccaggcgatgtgc

SEQ ID NO: 1982 - DNA, 50 bp, Homo sapiens
tcaccagtccctccccaaatgctttccatgagttgcagttttttcctagt

SEQ ID NO: 1983 - DNA, 50 bp, Homo sapiens
tactttggggacttgtagggatgcctttctagtcctattctattgcagtt

SEQ ID NO: 1984 - DNA, 50 bp, Homo sapiens
ccatcggtgaaactaacagataagcaagagagatgttttggggactcatt

SEQ ID NO: 1985 - DNA, 50 bp, Homo sapiens; identical to SEQ ID NO: 1781

SEQ ID NO: 1986 - DNA, 50 bp, Homo sapiens
caccaggaacctgctttagtgggggatagtgaagaagacaataaaagata

SEQ ID NO: 1987 - DNA, 50 bp, Homo sapiens
ggctacagaaagaagatgccagatgacacttaagacctacttgtgatatt

SEQ ID NO: 1988 - DNA, 50 bp, Homo sapiens
gcatttccacaccaagcagcaacagcaaatcacgaccactgatagatgtc

SEQ ID NO: 1989 - DNA, 50 bp, Homo sapiens
tccccaaaccataaaaccctatacaagttgttctagtaacaatacatgag

SEQ ID NO: 1990 - DNA, 50 bp, Homo sapiens
gcttccggtccttagccttcccaggtgggactttaggcatgattaaaata

SEQ ID NO: 1991 - DNA, 50 bp, Homo sapiens
tgctattgccttcctattttgcataataaatgcttcagtgaaaatgcagc

SEQ ID NO: 1992 - DNA, 50 bp, Homo sapiens
ggaagaagagggagagatggagcaaagtgagggccgagtgagagcgtgct

SEQ ID NO: 1993 - DNA, 50 bp, Homo sapiens; identical to SEQ ID NO: 1831

SEQ ID NO: 1994 - DNA, 50 bp, Homo sapiens
ctcagctaaaaggccacccctttatcgcattgctgtccttgggtagaata

SEQ ID NO: 1995 - DNA, 50 bp, Homo sapiens
accttatgaactacagtggagctacactcattgaaatgtaatttcagttc

SEQ ID NO: 1996 - DNA, 50 bp, Homo sapiens; identical to SEQ ID NO: 32

SEQ ID NO: 1997 - DNA, 50 bp, Homo sapiens
gccagatttggggcatttggaaagaagttcattgaagataaagcaaaagt

SEQ ID NO: 1998 - DNA, 50 bp, Homo sapiens
ctgcacccttcccccagcaccatttatgagtctcaagttttattattgca

SEQ ID NO: 1999 - DNA, 50 bp, Homo sapiens
ttttgaagaagggaaattcacactgtgcgttttgagtatgcaagaagaat

SEQ ID NO: 2000 - DNA, 50 bp, Homo sapiens
tgttgtgactttttagccagtgactttttctgagcttttcatggaagtgg

SEQ ID NO: 2001 - DNA, 50 bp, Homo sapiens
acttcacacagacaagtggctaagtgtccattatttaccttgaacaatca

SEQ ID NO: 2002 - DNA, 50 bp, Homo sapiens; identical to SEQ ID NO: 433

SEQ ID NO: 2003 - DNA, 50 bp, Homo sapiens; identical to SEQ ID NO: 1787

SEQ ID NO: 2004 - DNA, 50 bp, Homo sapiens
atggaaattgtatttgccttctccactttgggaggctcccacttcttggg

SEQ ID NO: 2005 - DNA, 50 bp, Homo sapiens
tcagagggaaagtaaatatttcaggcatactgacactttgccagaaagca

SEQ ID NO: 2006 - DNA, 50 bp, Homo sapiens
gtgtaacacagtgccttcaataaatggtatagcaaatgttttgacatgaa

SEQ ID NO: 2007 - DNA, 50 bp, Homo sapiens
tgggactattacatccacatgatacctctgatcaagtatttttgacattt

SEQ ID NO: 2008 - DNA, 50 bp, Homo sapiens
cattcgtatgagaagcggcttttctgaaaagggatccagcacacctcctc

SEQ ID NO: 2009 - DNA, 50 bp, Homo sapiens
cttcagactgaacatgtacactggtttgagcttagtgaaatgacttccgg

SEQ ID NO: 2010 - DNA, 50 bp, Homo sapiens
tttaaatgtttgtgttaatacacattaaaacatcgcacaaaaacgatgca

SEQ ID NO: 2011 - DNA, 50 bp, Homo sapiens
gcaaccttgcatccatctgggctaccccacccaagtatacaataaagtct

SEQ ID NO: 2012 - DNA, 50 bp, Homo sapiens
tgctggtggggaaagacttaaaagtggattaaagacctgcgtattgatga

SEQ ID NO: 2013 - DNA, 50 bp, Homo sapiens
aggggcgctcgcttccgcatcctagtctctatcattaaagttctagtgac

SEQ ID NO: 2014 - DNA, 50 bp, Homo sapiens
agctgatcctcgggaagaacaaagctaaagctgccttttgtctgttattt

SEQ ID NO: 2015 - DNA, 50 bp, Homo sapiens
cacaggcccatggactcacttttgtaacaaactcctaccaacactgacca

SEQ ID NO: 2016 - DNA, 50 bp, Homo sapiens
aggaggagtttctattaaaatctgtcacttgagtgatgtcatttaagtcc

SEQ ID NO: 2017 - DNA, 50 bp, Homo sapiens
cctgtgcaatagacacatacatgtcacatttagctgtgctcagaagggct

SEQ ID NO: 2018 - DNA, 50 bp, Homo sapiens; identical to SEQ ID NO: 2017

SEQ ID NO: 2019 - DNA, 50 bp, Homo sapiens
tgcacctgttactgttgggctttccactgagatctactggataaagaata

SEQ ID NO: 2020 - DNA, 50 bp, Homo sapiens
aagaaggagcttaatgccaggaacagattttgcagttggtggggtctcaa

SEQ ID NO: 2021 - DNA, 50 bp, Homo sapiens
agggctacctgcgatctgtgtttgctctgacgaatggaatttatcctcac

SEQ ID NO: 2022 - DNA, 50 bp, Homo sapiens
ccatgattatttttctaagctggttggttaataaacagtacctgctctca

SEQ ID NO: 2023 - DNA, 50 bp, Homo sapiens
aaaggctaaagaacttgccactaaactgggttaaatgtacactgttgagt

SEQ ID NO: 2024 - DNA, 50 bp, Homo sapiens
ggaaccaagactgtgcaggagaaagagaactagtgctgagggcctcaata

SEQ ID NO: 2025 - DNA, 50 bp, Homo sapiens
tggttccagcagaagtatgatgggatcatccttcctggcaaataaattcc

SEQ ID NO: 2026 - DNA, 50 bp, Homo sapiens
ttggttgtttggttagtgactgatgtaaaacggttttcttgtggggaggt

SEQ ID NO: 2027 - DNA, 50 bp, Homo sapiens
atgctggcagcattgcatgattctccagtatatttgtaaaaaataaaaaa

SEQ ID NO: 2028 - DNA, 50 bp, Homo sapiens
cgggccagccgaggctacaaaaactaaccctggatcctactctcttatta

SEQ ID NO: 2029 - DNA, 50 bp, Homo sapiens; identical to SEQ ID NO: 106

SEQ ID NO: 2030 - DNA, 50 bp, Homo sapiens
ttcaactaaagcgccacctgctccacccagagaagcacactttgtgagaa

SEQ ID NO: 2031 - DNA, 50 bp, Homo sapiens
ttggaaatcatagtcaaagggcttccttggttcgccactcatttatttgt

SEQ ID NO: 2032 - DNA, 50 bp, Homo sapiens; identical to SEQ ID NO: 2031

SEQ ID NO: 2033 - DNA, 50 bp, Homo sapiens
cctgatggagagaagaaggcatatgttcgactggctcctgattacgatgc

SEQ ID NO: 2034 - DNA, 50 bp, Homo sapiens
cagaagaaactgaagaaacaaaaacttatggcacgggagtaaattcagca

SEQ ID NO: 2035 - DNA, 50 bp, Homo sapiens
gtttcagctccccgagttggtggaaaacgctaaactggcagattagattt

SEQ ID NO: 2036 - DNA, 50 bp, Homo sapiens
ctcctgttgggtaagggtgttgagtgtgacttgtgctgaaaacctggttc

SEQ ID NO: 2037 - DNA, 50 bp, Homo sapiens
gaacaagtggttcttccagaaactgcggttttagatgctttgttttgatc

SEQ ID NO: 2038 - DNA, 50 bp, Homo sapiens
ggcttgaagccacatggagggagtttcattaaatgctaactacttttaaa

SEQ ID NO: 2039 - DNA, 50 bp, Homo sapiens
atctacagacagtcaatgtggatgagaactaatcgctgatcaaataacgt

SEQ ID NO: 2040 - DNA, 50 bp, Homo sapiens
gcgcagtgaagaaaatgagtaggcagctcatgtgcacgttttctgtttaa

SEQ ID NO: 2041 - DNA, 50 bp, Homo sapiens
caatcttcctgctaaggccattggacacagaatccgagtgatgctgtacc

SEQ ID NO: 2042 - DNA, 50 bp, Homo sapiens
ggcagctgttgcagcatccagttcatcttaagaatgtcaacgattagtca

SEQ ID NO: 2043 - DNA, 50 bp, Homo sapiens
agacgctcctctactctttggagacatcactggcctataataaatgggtt

SEQ ID NO: 2044 - DNA, 50 bp, Homo sapiens
tctgttatgaacacgttggttggctggattcagtaataaatatgtaaggc

SEQ ID NO: 2045 - DNA, 50 bp, Homo sapiens
tgagaagaaggaggagtctgaagagtcagatgatgacatgggatttggcc

SEQ ID NO: 2046 - DNA, 50 bp, Homo sapiens
gctaaagttgaacgagctgatggatatgaaccaccagtccaagaatctgt

SEQ ID NO: 2047 - DNA, 50 bp, Homo sapiens
gctggccaccaaacagagcagtggctaaattgcagtagcagcatatcttt

SEQ ID NO: 2048 - DNA, 50 bp, Homo sapiens
gccaagtccaaccgctgattttcccagctgctgcccaataaacctgtctg

SEQ ID NO: 2049 - DNA, 50 bp, Homo sapiens
tggtgtctataagaagctcacgggcaaggatgttaattttgaattcccag

SEQ ID NO: 2050 - DNA, 50 bp, Homo sapiens; identical to SEQ ID NO: 78

SEQ ID NO: 2051 - DNA, 50 bp, Homo sapiens
catctacagcctctgccctggtcgcataaatttgtctgtgtactcaagca

SEQ ID NO: 2052 - DNA, 50 bp, Homo sapiens
ctaccagaaatcctaccgataagcccatcgtgactcaaaactcacttgta

SEQ ID NO: 2053 - DNA, 50 bp, Homo sapiens
ctcggggacctgtttgaattttttctgtagtgctgtattattttcaataa

SEQ ID NO: 2054 - DNA, 50 bp, Homo sapiens
gctgccaacaagaagcattagaacaaaccatgctgggttaataaattgcc

SEQ ID NO: 2055 - DNA, 50 bp, Homo sapiens
gatggcatcgtctcaaagaacttttgactggagagaatcacagatgtgga

SEQ ID NO: 2056 - DNA, 50 bp, Homo sapiens; identical to SEQ ID NO: 2055

SEQ ID NO: 2057 - DNA, 50 bp, Homo sapiens
ccaatgtttctcttttggccctatacaaaggcaagaaggaaagaccaaga

SEQ ID NO: 2058 - DNA, 50 bp, Homo sapiens
ctggcaaaaagccgaaggagtaaaggtgctgcaatgatgttagctgtggc

SEQ ID NO: 2059 - DNA, 50 bp, Homo sapiens
tggtgaagatgcatgaataggtccaaccagctgtacatttggaaaaataa

SEQ ID NO: 2060 - DNA, 50 bp, Homo sapiens
gccagtgtttccgtcagtacgcgaaggatatcggtttcattaagttggac

SEQ ID NO: 2061 - DNA, 50 bp, Homo sapiens
gagtgataactcatgagaagtactgataggacctttatctggatatggtc

SEQ ID NO: 2062 - DNA, 50 bp, Homo sapiens
ggtgattcttctctgttgaactgaagtttgtgagagtagttttcctttgc

SEQ ID NO: 2063 - DNA, 50 bp, Homo sapiens; identical to SEQ ID NO: 1804

SEQ ID NO: 2064 - DNA, 50 bp, Homo sapiens
ggggaaggtgtttttagtacaagacatcaaagtgaagtaaagcccaagtg

SEQ ID NO: 2065 - DNA, 50 bp, Homo sapiens
aggaaaacatccaaaacaacaagcaagaaaccgaagaagacatcttttga

SEQ ID NO: 2066 - DNA, 50 bp, Homo sapiens
agctgccacctcagtctcttctctgtattatcatagtctggtttaaataa

SEQ ID NO: 2067 - DNA, 50 bp, Homo sapiens
ggaggcagccagggcttacctgtacactgacttgagaccagttgaataaa

SEQ ID NO: 2068 - DNA, 50 bp, Homo sapiens
agcaaagatttcagtagaattttagtcctgaacgctacggggaaaatgca

SEQ ID NO: 2069 - DNA, 50 bp, Homo sapiens
tggtggtattcagtggtccaggattctgtaatgctttacacaggcagttt

SEQ ID NO: 2070 - DNA, 50 bp, Homo sapiens
tgcttttatgtgtcccttgataacagtgacttaacaatatacattcctca

SEQ ID NO: 2071 - DNA, 50 bp, Homo sapiens
ttgtttcaaaatgctgtttcatttttataaagtaccagtgtttagctgct

SEQ ID NO: 2072 - DNA, 50 bp, Homo sapiens
agagatggacaagagcagccaggagacccagcgatctgagcataaaactc

SEQ ID NO: 2073 - DNA, 50 bp, Homo sapiens
tgaaagagaaagactgattacctcctgtgtggaagaaggaaacaccgagt

SEQ ID NO: 2074 - DNA, 50 bp, Homo sapiens
ggaatacctcagaagagatgcttcattgagtgttcattaaaccacacatg

SEQ ID NO: 2075 - DNA, 50 bp, Homo sapiens
accatgatactttaattagaagcttagccttgaaattgtgaactcttgga

SEQ ID NO: 2076 - DNA, 50 bp, Homo sapiens; identical to SEQ ID NO: 2075

SEQ ID NO: 2077 - DNA, 50 bp, Homo sapiens
gcctctgccctggtttggctatgtcagatccaataaacatcctgaacctc

SEQ ID NO: 2078 - DNA, 50 bp, Homo sapiens
tgccttttctaccccatccctcacagcctcttgctgctaaaatagatgtt

SEQ ID NO: 2079 - DNA, 50 bp, Homo sapiens
ggccaggcccaagtaagtgtaccttgtactttataaataaacctcaagca

SEQ ID NO: 2080 - DNA, 50 bp, Homo sapiens
gccgaattgtctttggtgcttttcacttgtgttttaaaataaggattttt

SEQ ID NO: 2081 - DNA, 50 bp, Homo sapiens; identical to SEQ ID NO: 1720

SEQ ID NO: 2082 - DNA, 50 bp, Homo sapiens
agaagtcccccatgtggatatttcttatactaattgtatcataaagccgt

SEQ ID NO: 2083 - DNA, 50 bp, Homo sapiens
gggcaggagcatggggtgcttggttgtttccttcctaataaaataaacgc

SEQ ID NO: 2084 - DNA, 50 bp, Homo sapiens
atgcatttggtatgaatctgtggttgtatctgttcaattctaaagtacaa

SEQ ID NO: 2085 - DNA, 50 bp, Homo sapiens
ttctctaggttactgttgggagcttaatggtagaaacttccttggtttca

SEQ ID NO: 2086 - DNA, 50 bp, Homo sapiens
cctcccagcaacccactacctctggtacctgtaaaggtcaaacaagaaac

SEQ ID NO: 2087 - DNA, 50 bp, Homo sapiens
ccgtgtctgtttgtaggcggagaaaccgttgggtaacttgttcaagatat

SEQ ID NO: 2088 - DNA, 50 bp, Homo sapiens
tgagggtgagggcaggctgaggcaacgagtgggaggttcaaacaagagtg

SEQ ID NO: 2089 - DNA, 50 bp, Homo sapiens
cccaaacaatctgtggatggaaaagcaccacttgctactggagaggatga

SEQ ID NO: 2090 - DNA, 50 bp, Homo sapiens
aatcaacttcaaggagcaccttcattagtacagcttgcatatttaacatt

SEQ ID NO: 2091 - DNA, 50 bp, Homo sapiens
aggcgatgatattctcaccatcctgactgaagtgaactatgaagtaagca

SEQ ID NO: 2092 - DNA, 50 bp, Homo sapiens
tgacgacctggtagaatctctctaaccatttgaagttgatttctcaatgc

SEQ ID NO: 2093 - DNA, 50 bp, Homo sapiens
gctgcgaaagacccacatgctacaagacgggcaaaataaagtgacagatg

SEQ ID NO: 2094 - DNA, 50 bp, Homo sapiens
cgcccatgatgggagggattgacatgtttcaacaaaataatgcacttcct

SEQ ID NO: 2095 - DNA, 50 bp, Homo sapiens
tctttcagatagcaggcagggaagcaatgtagtgtggtgggcagagcccc

SEQ ID NO: 2096 - DNA, 50 bp, Homo sapiens
caggaggatggcaaagagagtcgcatctcagtgcaggagagacagtgagg

SEQ ID NO: 2097 - DNA, 50 bp, Homo sapiens
gggggtagtggtggcaggacaagagaaggcattgagctttttctttcatt

SEQ ID NO: 2098 - DNA, 50 bp, Homo sapiens
gccatgaaggagcaagttttgtatttgtgacctcagctttgggaataaag

SEQ ID NO: 2099 - DNA, 50 bp, Homo sapiens; identical to SEQ ID NO: 621

SEQ ID NO: 2100 - DNA, 50 bp, Homo sapiens
accaagtttcaggggacatgagttttccagcttttatacacacgtatctc

SEQ ID NO: 2101 - DNA, 50 bp, Homo sapiens
ggcaaatgaggaacagggcaatagtatgatgaatcttgattggagttggt

SEQ ID NO: 2102 - DNA, 50 bp, Homo sapiens; identical to SEQ ID NO: 165

SEQ ID NO: 2103 - DNA, 50 bp, Homo sapiens
tataccatgagatgagatgaccaccaatcatttccttggggggagggggt

SEQ ID NO: 2104 - DNA, 50 bp, Homo sapiens
cctaggaaatcacaggcttctgagcacagctgcattaaaacaaaggaagt

SEQ ID NO: 2105 - DNA, 50 bp, Homo sapiens
aaatgtaaccttttgctttccaaattaaagaactccatgccactcctcaa

SEQ ID NO: 2106 - DNA, 50 bp, Homo sapiens
acacacatacacacaccccaaaacacatacattgaaagtgcctcatctga

SEQ ID NO: 2107 - DNA, 50 bp, Homo sapiens
gaccctatcctcccaccgcctccgttaacacgatcctgaataaatcttga

SEQ ID NO: 2108 - DNA, 50 bp, Homo sapiens
acagcaaagcccattggccagaaaggaaagacaataattttgttttttca

SEQ ID NO: 2109 - DNA, 50 bp, Homo sapiens
aaggagtaaagatttgcctttaaataacttggtattttcctggctttcgt

SEQ ID NO: 2110 - DNA, 50 bp, Homo sapiens
ggcctcgtttacttttaaaaaatgaaattgttcattgctgggagaagaat

SEQ ID NO: 2111 - DNA, 50 bp, Homo sapiens
tcaactaatgatttagtgatcaaattgtgcagtactttgtgcattctgga

SEQ ID NO: 2112 - DNA, 50 bp, Homo sapiens
taggtttctgacttttgtggatcattttgcacatagctttatcaactttt

SEQ ID NO: 2113 - DNA, 50 bp, Homo sapiens
aaatcagtactttttaatggaaacaacttgacccccaaatttgtcacaga

SEQ ID NO: 2114 - DNA, 50 bp, Homo sapiens; identical to SEQ ID NO: 88

SEQ ID NO: 2115 - DNA, 50 bp, Homo sapiens
caggaggggggagggaagggagccaagggatggacatcttgtcatttttt

SEQ ID NO: 2116 - DNA, 50 bp, Homo sapiens
gcaagtatgctgctctctctgttgatggtgaagatgaaaatgagggagaa

SEQ ID NO: 2117 - DNA, 50 bp, Homo sapiens
ttgtgggtgtgaaacaaatggtgagaatttgaattggtccctcctattat

SEQ ID NO: 2118 - DNA, 50 bp, Homo sapiens
aaagggaaaaagacctcgtggagaatttttactggggattcttgaacttg

SEQ ID NO: 2119 - DNA, 50 bp, Homo sapiens
aaatgtatttactatgcgtgtttccagcagttggcattaaagtgcctttt

SEQ ID NO: 2120 - DNA, 50 bp, Homo sapiens
atttgcattactctggtggattgttctagtactgtattgggcttcttcgt

SEQ ID NO: 2121 - DNA, 50 bp, Homo sapiens
gaggaggtctcttctatgccaccggcctctgccagctttgcaccagcgtg

SEQ ID NO: 2122 - DNA, 50 bp, Homo sapiens; identical to SEQ ID NO: 1465

SEQ ID NO: 2123 - DNA, 50 bp, Homo sapiens
tttgaagagccattttggtaaacggtttttattaaagatgctatggaaca

SEQ ID NO: 2124 - DNA, 50 bp, Homo sapiens
gtcaggattgcgagagatgtgtgttgatactgttgcacgtgtgtttttct

SEQ ID NO: 2125 - DNA, 50 bp, Homo sapiens; identical to SEQ ID NO: 1857

SEQ ID NO: 2126 - DNA, 50 bp, Homo sapiens
taatggccccttaccctgggtgaagcacttacccttggaacagaactcta

SEQ ID NO: 2127 - DNA, 50 bp, Homo sapiens
aaggcctcatcctggggaggatacgtaggcacacagaggggagtcaccag

SEQ ID NO: 2128 - DNA, 50 bp, Homo sapiens
tggggtaagtggagttgggaaatacaagaagagaaagaccagtggggatt

SEQ ID NO: 2129 - DNA, 50 bp, Homo sapiens
acctagcggacaatgatggagagatctatgatgatattgctgatggctgc

SEQ ID NO: 2130 - DNA, 50 bp, Homo sapiens
gtgatggtgtagccctcccactttgctgttccttactttactgcctgaat

SEQ ID NO: 2131 - DNA, 50 bp, Homo sapiens
gcctctacttctgtctcaaaatggctccaaatgatttctgtactgcaaaa

SEQ ID NO: 2132 - DNA, 50 bp, Homo sapiens
tctccttccacagtttatttcctcgcttcctttgcatctaaacctttctt

SEQ ID NO: 2133 - DNA, 50 bp, Homo sapiens
acactgttgccctggctgtattcataagattccagctccttcaggtgttt

SEQ ID NO: 2134 - DNA, 50 bp, Homo sapiens
gtcaatattctgcaatttcagccccatttgtactacgtgcgagacagcct

SEQ ID NO: 2135 - DNA, 50 bp, Homo sapiens
ggcgggactgggcggggcggggcatcagaactcaggtgttttttatttac

SEQ ID NO: 2136 - DNA, 50 bp, Homo sapiens
ttccttttgctctttgtggttggatctaacactaactgtattgttttgtt

SEQ ID NO: 2137 - DNA, 50 bp, Homo sapiens
acgtcttccaaataaattatgtgttggtgccatcgcacatgctcaataaa

SEQ ID NO: 2138 - DNA, 50 bp, Homo sapiens; identical to SEQ ID NO: 1705

SEQ ID NO: 2139 - DNA, 50 bp, Homo sapiens
ctgagactggctgctgactttgagaactctgtgagacaaggtccttaggc

SEQ ID NO: 2140 - DNA, 50 bp, Homo sapiens
gcagggaagctttgcatgttgctctaaggtacatttttaaagagttgttt

SEQ ID NO: 2141 - DNA, 50 bp, Homo sapiens
cgaaccaaagctagaagcaaatgtcgagataagagagcagatgttggaga

SEQ ID NO: 2142 - DNA, 50 bp, Homo sapiens
ggaaggaaaagagtgctgagaaatggctctgtataatctatggctatccg

SEQ ID NO: 2143 - DNA, 50 bp, Homo sapiens
accaaggctagaaccacctgcctatattttttgttaaatgatttcattca

SEQ ID NO: 2144 - DNA, 50 bp, Homo sapiens
cctctgccaaagtactcttaggtgccagtctggtaactgaactccctctg

SEQ ID NO: 2145 - DNA, 50 bp, Homo sapiens
aaaataatgcaccacttttaacagaacagacagatgaggacagagctggt

SEQ ID NO: 2146 - DNA, 50 bp, Homo sapiens
gaattgggggatagatctataatgttcactgttcaaaacgaagactagct

SEQ ID NO: 2147 - DNA, 50 bp, Homo sapiens
ccgtttgctttcagaaaatgttttagggtaaatgcataagactatgcaat

SEQ ID NO: 2148 - DNA, 50 bp, Homo sapiens
cccaaattctttcagtggctacctacatacaattccaaacacatacagga

SEQ ID NO: 2149 - DNA, 50 bp, Homo sapiens
aaattaataagtcacaagaaaaacaaaagtgccagaagatgtccagccac

SEQ ID NO: 2150 - DNA, 50 bp, Homo sapiens
agaggctcctaactgggcaactcaagattctggcttctactgaagaacca

SEQ ID NO: 2151 - DNA, 50 bp, Homo sapiens
ggttttctactgttatgtgagaacattaggccccagcaacacgtcattgt

SEQ ID NO: 2152 - DNA, 50 bp, Homo sapiens
cagcttctgccacttcccaggtaagcaggaggaggtgccaacagtgttag

SEQ ID NO: 2153 - DNA, 50 bp, Homo sapiens
accatttttgttactctcttccacatgttactggataaattgtttagtgg

SEQ ID NO: 2154 - DNA, 50 bp, Homo sapiens
gtgccactaacggttgagttttgactgcttggaactggaatcctttcagc

SEQ ID NO: 2155 - DNA, 50 bp, Homo sapiens
tctccaccaccatctcccctctacttctcatttcctaactctctgctgaa

SEQ ID NO: 2156 - DNA, 50 bp, Homo sapiens
ggtgttggacttaaatcagttgaaatgtatttctgtaccacaatttacgc

SEQ ID NO: 2157 - DNA, 50 bp, Homo sapiens
cccttccgctgttcctgaaataacctttcataaagtgctttgggtgccat

SEQ ID NO: 2158 - DNA, 50 bp, Homo sapiens
ttctcatgtataaaactaggaatcctccaaccaggctcctgtgatagagt

SEQ ID NO: 2159 - DNA, 50 bp, Homo sapiens
agacacgtctatcagcttattccttctctactggaatattggtatagtca

SEQ ID NO: 2160 - DNA, 50 bp, Homo sapiens
tgtctggtaacaagatgtgactttttggtagcactgttgtggttcattct

SEQ ID NO: 2161 - DNA, 50 bp, Homo sapiens
tcctctttccagtggatcataagacaatggaccctttttgttatgatggt

SEQ ID NO: 2162 - DNA, 50 bp, Homo sapiens
actgttttgtatacttgttttcagttttcatttcgacaaacaagcactgt

SEQ ID NO: 2163 - DNA, 50 bp, Homo sapiens
acatagtttttatttttgtgtctgtgaaagtgccaagaacccctccccac

SEQ ID NO: 2164 - DNA, 50 bp, Homo sapiens
tcacctggacttaagcgtctggctctaattcacagtgctctttctcctca

SEQ ID NO: 2165 - DNA, 50 bp, Homo sapiens
agatgcctggcagggctgggtggcgattcataaagacctcgtgttgattc

SEQ ID NO: 2166 - DNA, 50 bp, Homo sapiens
ggatagtcaggagcgtcaatgtgcttgtacatagagtgctgtagctgtgt

SEQ ID NO: 2167 - DNA, 50 bp, Homo sapiens
ttgtgaaatatcttgttactgcttttatttagcagactgtggactgtaat

SEQ ID NO: 2168 - DNA, 50 bp, Homo sapiens
ctggaggacctgttgatgctagttcagagtatcaccaagagctggagagg

SEQ ID NO: 2169 - DNA, 50 bp, Homo sapiens
gctgcacaagagccttgattgaagatatattctttctgaacagtatttaa

SEQ ID NO: 2170 - DNA, 50 bp, Homo sapiens
ttgcctttataaaaacttgctgcctgactaaagattaacaggttatagtt

SEQ ID NO: 2171 - DNA, 50 bp, Homo sapiens
tggttctgctttttgacctctctctaccttttcagggtaatctttgtggc

SEQ ID NO: 2172 - DNA, 50 bp, Homo sapiens
cctgtccttgtgtttgtgtgtgctaacagaaataagttgcagtatggtcg

SEQ ID NO: 2173 - DNA, 50 bp, Homo sapiens
aaaagtgttggttttctgccatcagtgaaaattcttaaacttggagcaac

SEQ ID NO: 2174 - DNA, 50 bp, Homo sapiens
agggtttggctgtgtctaaactgcattaccgcgttgtaaaaaatagctgt

SEQ ID NO: 2175 - DNA, 50 bp, Homo sapiens
cctaggctgcgctccagcactgcggggcttttctgcaataaagtcacgag

SEQ ID NO: 2176 - DNA, 50 bp, Homo sapiens
ggcagcacagagacccccggaacaagcctaaaaattgtttcaaaataaaa

SEQ ID NO: 2177 - DNA, 50 bp, Homo sapiens
aagtcttttccacaaaccaccatctattttgtgaactttgttagtcatct

SEQ ID NO: 2178 - DNA, 50 bp, Homo sapiens
tggcaagttggaaaatatgtaactggaatctcaaaagttctttgggacaa

SEQ ID NO: 2179 - DNA, 50 bp, Homo sapiens
tctgcttatggcacaatttgcctcaaatccattccaagttgtatatttgt

SEQ ID NO: 2180 - DNA, 50 bp, Homo sapiens
ccattgttgtcaaatgcccagtgtccatcagatgtgttcctccattttct

SEQ ID NO: 2181 - DNA, 50 bp, Homo sapiens
gctgcctctgtaaattcatgtattcaaaggaaaagacaccttgcctataa

SEQ ID NO: 2182 - DNA, 50 bp, Homo sapiens
tcaagtcagcaacagagcaaaataaaggttagataagtccttgtgtagca

SEQ ID NO: 2183 - DNA, 50 bp, Homo sapiens; identical to SEQ ID NO: 1719

SEQ ID NO: 2184 - DNA, 50 bp, Homo sapiens
tggttttgaatgcaattaggttatgctatttggacaataaactcaccttg

SEQ ID NO: 2185 - DNA, 50 bp, Homo sapiens
tgcaaggtttaggctggtggcccaggaccatcatcctactgtaataaaga

SEQ ID NO: 2186 - DNA, 50 bp, Homo sapiens
gtgtggtcggggtgagaacccaagcgttggaactgtagacccgtcctgtc

SEQ ID NO: 2187 - DNA, 50 bp, Homo sapiens
agcagcagtgacataaaattccatgttagataagcatatgttacttacct

SEQ ID NO: 2188 - DNA, 50 bp, Homo sapiens
ctccacaataaggtcaatgccagagacggaagcctttttccccaaagtct

SEQ ID NO: 2189 - DNA, 50 bp, Homo sapiens
tggaggtattcaatatcctttgcctcaaggacttcggcagatactgtctc

SEQ ID NO: 2190 - DNA, 50 bp, Homo sapiens
ggtgcccaccattcttggcctgttacttacctgagatgagctcttttaac

SEQ ID NO: 2191 - DNA, 50 bp, Homo sapiens
ttaagaagaaatacccactaacaaagaacaagcattagttttggctgtca

SEQ ID NO: 2192 - DNA, 50 bp, Homo sapiens; identical to SEQ ID NO: 248

SEQ ID NO: 2193 - DNA, 50 bp, Homo sapiens
gggcggcccggagccagccaggcagttttattgaaatctttttaaataat

SEQ ID NO: 2194 - DNA, 50 bp, Homo sapiens; identical to SEQ ID NO: 235

SEQ ID NO: 2195 - DNA, 50 bp, Homo sapiens
agagaacactggacaacattttactactgagggaaatagccaaaaaggca

SEQ ID NO: 2196 - DNA, 50 bp, Homo sapiens
catgggggcaacagccaaaataggggggtaatgatgtaggggccaagcag

SEQ ID NO: 2197 - DNA, 50 bp, Homo sapiens
ttctggaagatggtcagctatgaagtaatagagtttgcttaatcatttgt

SEQ ID NO: 2198 - DNA, 50 bp, Homo sapiens
gggtggctctgatatagtagctctggtgtagtttctgcatttcaagaaga

SEQ ID NO: 2199 - DNA, 50 bp, Homo sapiens
ttccagtcagtttttctcttaagtgcctgtttgagtttactgaaacagtt

SEQ ID NO: 2200 - DNA, 50 bp, Homo sapiens
aaggaccaaggagatgaagcaaacacattaagccttccacactcacctct

SEQ ID NO: 2201 - DNA, 50 bp, Homo sapiens
aggtgcagcctctggaagtggatcaaactagaactcatatgccatactag

SEQ ID NO: 2202 - DNA, 50 bp, Homo sapiens
acttaaaagtttagggttttctcttggttgtagagtggcccagaattgca

SEQ ID NO: 2203 - DNA, 50 bp, Homo sapiens
gtcttgtgactagtgctgaagcttattaatgctaagggcaggcccaaatt

SEQ ID NO: 2204 - DNA, 50 bp, Homo sapiens
ccagagctgctattagaagctgcttcctgtgaagatcaatcttcctgagt

SEQ ID NO: 2205 - DNA, 50 bp, Homo sapiens
tcctctttctcccagcttcaaatgcacaattcatcattgggctcacttct

SEQ ID NO: 2206 - DNA, 50 bp, Homo sapiens
cagcttcaccctgtcaagttaacaaggaatgcctgtgccaataaaaggtt

SEQ ID NO: 2207 - DNA, 50 bp, Homo sapiens
ctcgaatcattgaagatccgagtgtgatttgaattctgtgatattttcac

SEQ ID NO: 2208 - DNA, 50 bp, Homo sapiens
cttcatctggaagaagaggcaagggggcaggagaccaggctctagctctg

SEQ ID NO: 2209 - DNA, 50 bp, Homo sapiens
agactttgccattgttgccattgttttcttttgtacctgaagcattttga

SEQ ID NO: 2210 - DNA, 50 bp, Homo sapiens
aaaagtaggggaggggctgggtctgcaaattaataaatagaagagggggt

SEQ ID NO: 2211 - DNA, 50 bp, Homo sapiens; identical to SEQ ID NO: 467

SEQ ID NO: 2212 - DNA, 50 bp, Homo sapiens
tcagtaaacaaattctttcacaaggtacaaaatcttgcataagctgaact

SEQ ID NO: 2213 - DNA, 50 bp, Homo sapiens
gttttacttaggacaagttgtaccttgccctctctccagctctgctccca

SEQ ID NO: 2214 - DNA, 50 bp, Homo sapiens; identical to SEQ ID NO: 306

SEQ ID NO: 2215 - DNA, 50 bp, Homo sapiens
tggatgtggctgctttcaacaagatctaaaatccatcctggatcatggca

SEQ ID NO: 2216 - DNA, 50 bp, Homo sapiens
tgtggtgtatatccttccaaaaaattaaaacgaaaataaagtagctgcga

SEQ ID NO: 2217 - DNA, 50 bp, Homo sapiens
gtcttccatgtgaacagcataagtttggagcactagtttgattattatgt

SEQ ID NO: 2218 - DNA, 50 bp, Homo sapiens
gcccacacccacactctccagcatctggcacaataaacattctctgtttt

SEQ ID NO: 2219 - DNA, 50 bp, Homo sapiens
agctgtttcctgggtaaatctagagtggggttttggttctttattttccc

SEQ ID NO: 2220 - DNA, 50 bp, Homo sapiens
gcaggagacattggtattctgggcagcttcctaatatgctttacaatctg

SEQ ID NO: 2221 - DNA, 50 bp, Homo sapiens
tggttttcatatcaaaagatcatgttgggattaacttgcctttttcccca

SEQ ID NO: 2222 - DNA, 50 bp, Homo sapiens
atctacaagcggagaaagtgacctagagattgcaagggcggggagaggag

SEQ ID NO: 2223 - DNA, 50 bp, Homo sapiens
tgtttaaatggcttggtgtctttcttttctaattatgcagaataagctct

SEQ ID NO: 2224 - DNA, 50 bp, Homo sapiens
aaaactgtactttgattcacatgttttcaaatggagttggagttcattca

SEQ ID NO: 2225 - DNA, 50 bp, Homo sapiens
tccatcagagctggtctgcacactcacattatcttgctatcactgtaacc

SEQ ID NO: 2226 - DNA, 50 bp, Homo sapiens
gacactttcgagctcccagctccagcttcgtctcaccttgagttaggctg

SEQ ID NO: 2227 - DNA, 50 bp, Homo sapiens; identical to SEQ ID NO: 115

SEQ ID NO: 2228 - DNA, 50 bp, Homo sapiens
aggagtcttttacccggtgtgctttgccgcagtcatccaaaataaattca

SEQ ID NO: 2229 - DNA, 50 bp, Homo sapiens
tagggagccgcaccttgtcatgtaccatcaataaagtaccctgtgctcaa

SEQ ID NO: 2230 - DNA, 50 bp, Homo sapiens
gctgtatataaacgtgtcccgagcttagattctgtatgcggtgacggcgg

SEQ ID NO: 2231 - DNA, 50 bp, Homo sapiens
tgtcttatgtgtcaaaagtcctaggaaagtggttgatgtttcttatagca

SEQ ID NO: 2232 - DNA, 50 bp, Homo sapiens
gctgaatgacatattttatcttgttctttaaaatcacaacacagagctgc

SEQ ID NO: 2233 - DNA, 50 bp, Homo sapiens
tgtctctctctctttttcttttctatggagcaaaacaaagctgatttccc

SEQ ID NO: 2234 - DNA, 50 bp, Homo sapiens
cagtgtactgcaaggaagctggatgcaagatagatactatattaaactgt

SEQ ID NO: 2235 - DNA, 50 bp, Homo sapiens
tgtattgtatgcaaatctgtgattgttggcagtgtcatctctgagaaaca

SEQ ID NO: 2236 - DNA, 50 bp, Homo sapiens
ggggtgtttgtgtgtgtgcgcgtgtgcgtttcaataaagtttgtacactt

SEQ ID NO: 2237 - DNA, 50 bp, Homo sapiens
tttagtatttttcccccaggccagatcattcgtgagtgtgcgagtgtgtg

SEQ ID NO: 2238 - DNA, 50 bp, Homo sapiens
tgctttgtttaaaggactgcagaccaaggagtcgagctttctctcagagc

SEQ ID NO: 2239 - DNA, 50 bp, Homo sapiens
accttatttccactctggtggataagttcaataaaggtcatatcccaaac

SEQ ID NO: 2240 - DNA, 50 bp, Homo sapiens
aatgttgtctgtcttctgtgctgttcctgtaagtttgctattaaaataca

SEQ ID NO: 2241 - DNA, 50 bp, Homo sapiens
accttcctcatttcacagataaggaatctttggggattaaccaacctcct

SEQ ID NO: 2242 - DNA, 50 bp, Homo sapiens
agatacctccccaccaccaattgccaaaggtccaataaaatgcctcaacc

SEQ ID NO: 2243 - DNA, 50 bp, Homo sapiens
gcaatccacaatctgacattctcaggaagcccccaagttgatatttctat

SEQ ID NO: 2244 - DNA, 50 bp, Homo sapiens
tctcaggctgcgtgcagcaacagtgcccagggctctgatgagtctctcat

SEQ ID NO: 2245 - DNA, 50 bp, Homo sapiens
gcctccaaccatgttcccttcttcttagcaccacaaataatcaaaaccca

SEQ ID NO: 2246 - DNA, 50 bp, Homo sapiens
ctcatcttcaacttttgtgctcccctttgcctaaaccctatggcctcctg

SEQ ID NO: 2247 - DNA, 50 bp, Homo sapiens; identical to SEQ ID NO: 818

SEQ ID NO: 2248 - DNA, 50 bp, Homo sapiens
tgtgtgtatggtagcacagcaaacttgtaggaattagtatcaatagtaaa

SEQ ID NO: 2249 - DNA, 50 bp, Homo sapiens
cctgcctggctctctcttcctaccctccttccacatgtacataaactgtc

SEQ ID NO: 2250 - DNA, 50 bp, Homo sapiens
agatgggaatgaagcttgtgtatccattatcatgtgtaatcaataaacga

SEQ ID NO: 2251 - DNA, 50 bp, Homo sapiens
ttaagatttttctcaaagttttgaaaagctattagccaggatcatggtgt

SEQ ID NO: 2252 - DNA, 50 bp, Homo sapiens; identical to SEQ ID NO: 647

SEQ ID NO: 2253 - DNA, 50 bp, Homo sapiens
ccattttgcctttctgacatttccttgggaatctgcaagaacctcccctt

SEQ ID NO: 2254 - DNA, 50 bp, Homo sapiens
ttccgtttggtagactccttccaatgaaatctcaggaataattaaactct

SEQ ID NO: 2255 - DNA, 50 bp, Homo sapiens
ggcagagaaggaggagtatgagcatcagaagagggagctggagcaaatct

SEQ ID NO: 2256 - DNA, 50 bp, Homo sapiens
agcagcctttctgtggagagtgagaataattgtgtacaaagtagagaagt

SEQ ID NO: 2257 - DNA, 50 bp, Homo sapiens
aatgataactaatgacatccagtgtctccaaaattgtttccttgtactga

SEQ ID NO: 2258 - DNA, 50 bp, Homo sapiens
tccctctgggactggacaattgcttcaagcattcttcaaccagcagatgc

SEQ ID NO: 2259 - DNA, 50 bp, Homo sapiens
cggctacatgcctcagtgaaggactagtagttcctgctacaacttcagca

SEQ ID NO: 2260 - DNA, 50 bp, Homo sapiens
catgagtcaagagcatcctgcttctaccatgtggatttggtcacaaggtt

SEQ ID NO: 2261 - DNA, 50 bp, Homo sapiens
gtcagaggtcctgtctggatggaggctggaggctcccccctcaacccctc

SEQ ID NO: 2262 - DNA, 50 bp, Homo sapiens
cctgatacacaattatgaccagaaaatatggctccatgaaggtgctactt

SEQ ID NO: 2263 - DNA, 50 bp, Homo sapiens
attcaattccagagtagtttcaagtttcacatcgtaaccattttcgcccg

SEQ ID NO: 2264 - DNA, 50 bp, Homo sapiens
tggaaatgtcatctaaccattaagtcatgtgtgaacacataaggacgtgt

SEQ ID NO: 2265 - DNA, 50 bp, Homo sapiens
aattcccagatttgaagacaaaaatactctaattctaaccagagcaagct

SEQ ID NO: 2266 - DNA, 50 bp, Homo sapiens
tggcagctacccccttcttgagagtccaagaacctggagcagaaataatt

SEQ ID NO: 2267 - DNA, 50 bp, Homo sapiens; identical to SEQ ID NO: 1730

SEQ ID NO: 2268 - DNA, 50 bp, Homo sapiens
tgccaagcacagtgcctgcatgtatttatccaataaatgtgaaattctgt

SEQ ID NO: 2269 - DNA, 50 bp, Homo sapiens
accactgtatgtttacttctcaccatttgagttgcccatcttgtttcaca

SEQ ID NO: 2270 - DNA, 50 bp, Homo sapiens
ggctgagggttctgctgtcctgtgccaccccattaaagtgcagttcctcc

SEQ ID NO: 2271 - DNA, 50 bp, Homo sapiens; identical to SEQ ID NO: 1840

SEQ ID NO: 2272 - DNA, 50 bp, Homo sapiens
agtctctaaagagtttattttaagacgtgtttgtgtttgtgtgtgtttgt

SEQ ID NO: 2273 - DNA, 50 bp, Homo sapiens
tggaagactaaagaggtgcaatgtgatctgagcctccatcattgtcctcc

SEQ ID NO: 2274 - DNA, 50 bp, Homo sapiens
gcagccagcagatctcagcagcccagtccaaataaacgtcctgtctagca

SEQ ID NO: 2275 - DNA, 50 bp, Homo sapiens
ggtaggagcaaccactgactggtcttaagctgttcttgcataggctctta

SEQ ID NO: 2276 - DNA, 50 bp, Homo sapiens
tcagctacactttgtttttaagtttgtttttgacatgtttatttggcaaa

SEQ ID NO: 2277 - DNA, 50 bp, Homo sapiens
tcccccctccgcctcccaggaagaaagaatgttactgccttaataaaaaa

SEQ ID NO: 2278 - DNA, 50 bp, Homo sapiens
gtgaatttgggctcacagaatcaaagcctatgcttggtagctcttgaaca

SEQ ID NO: 2279 - DNA, 50 bp, Homo sapiens
tccttcctttccactgaaaagcacatggccttgggtgacaaattcctctt

SEQ ID NO: 2280 - DNA, 50 bp, Homo sapiens
agaaatgttcagtaatgaaaaaatatatccaatcagagccatcccgaaaa

SEQ ID NO: 2281 - DNA, 50 bp, Homo sapiens
ttttaacttttaaggttgaaaagacaatagcccaaagccaagaaagaaaa

SEQ ID NO: 2282 - DNA, 50 bp, Homo sapiens
gcactcctttgtcatatactctgcatcactgtcatactcacaacttcgtg

SEQ ID NO: 2283 - DNA, 50 bp, Homo sapiens
tggcagtgggaaaaatgtaggagactgtttggaaattgattttgaacctg

SEQ ID NO: 2284 - DNA, 50 bp, Homo sapiens
catgcaaataaaaagaatgggacctaaactcgtgccgctcgtgccgaatt

SEQ ID NO: 2285 - DNA, 50 bp, Homo sapiens
ggattgcccatccatctgcttacaattccctgctgtcgtcttagcaagaa

SEQ ID NO: 2286 - DNA, 50 bp, Homo sapiens
gagcactggattgctttcccattatgagcgtccttcatctgggcagaccc

SEQ ID NO: 2287 - DNA, 50 bp, Homo sapiens; identical to SEQ ID NO: 1765

SEQ ID NO: 2288 - DNA, 50 bp, Homo sapiens; identical to SEQ ID NO: 1772

SEQ ID NO: 2289 - DNA, 50 bp, Homo sapiens; identical to SEQ ID NO: 1572

SEQ ID NO: 2290 - DNA, 50 bp, Homo sapiens
gacatgcgggctgggcagctgttagagtccaacgtggggcagcacagaga

SEQ ID NO: 2291 - DNA, 50 bp, Homo sapiens
accaaaattcagtgaaggcattctacaagttttgagttagcattacattt

SEQ ID NO: 2292 - DNA, 50 bp, Homo sapiens
taacactgcatcggatgcggggcgtggaggcaccgctgtattaaaggaag

SEQ ID NO: 2293 - DNA, 50 bp, Homo sapiens
tccatcgagcacgtctgaaacccctggtagccccgacttctttttaatta

SEQ ID NO: 2294 - DNA, 50 bp, Homo sapiens
cagtcactggtgtcaccctggataggcaagggataactcttctaacacaa

SEQ ID NO: 2295 - DNA, 50 bp, Homo sapiens
gggaagcactcgtgtgcaacagacaagtgactgtatctgtgtagactatt

SEQ ID NO: 2296 - DNA, 50 bp, Homo sapiens
tctatgagctttgtcagtgcgcgtagatgtcaataaatgttacatacaca

SEQ ID NO: 2297 - DNA, 50 bp, Homo sapiens
atatggtgctgttttctacccttggaaagaaatgtagatgatatgtttcg

SEQ ID NO: 2298 - DNA, 50 bp, Homo sapiens
ttgctaggcgagatagggggaagacagatatgggtgtttttaataaatct

SEQ ID NO: 2299 - DNA, 50 bp, Homo sapiens
aagttgcttcctaacatccttggactgagaaattatacttacttctggca

SEQ ID NO: 2300 - DNA, 50 bp, Homo sapiens
ctcaggcaaagaaaatgaaatgcatatttgcaaagtgtattaggaagtgt

SEQ ID NO: 2301 - DNA, 50 bp, Homo sapiens
tggaagagaggaataaataattcacctatatgtgtttgaggttgtgacag

SEQ ID NO: 2302 - DNA, 50 bp, Homo sapiens
gcctgagcaaagggcctgcccagacaagattttttaattgtttaaaaacc

SEQ ID NO: 2303 - DNA, 50 bp, Homo sapiens
aaatgacacatctgtgcaatagaatgatgtctgctctagggaaaccttca

SEQ ID NO: 2304 - DNA, 50 bp, Homo sapiens
atatttttatttgtttcagttcagataattggcaactgggtgaatctggc

SEQ ID NO: 2305 - DNA, 50 bp, Homo sapiens
ttcccaggaccgaacaagttccagaaaagactgaagaataatcacaattc

SEQ ID NO: 2306 - DNA, 50 bp, Homo sapiens
ttccttatctccctcagacgcagagtttttagtttctctagaaattttgt

SEQ ID NO: 2307 - DNA, 50 bp, Homo sapiens
ttttggaggggtttatgctcaatccatgttctatttcagtgccaataaaa

SEQ ID NO: 2308 - DNA, 50 bp, Homo sapiens
cattgagtggcgcagagccgggtttcatctggaattaactggatggaagg

SEQ ID NO: 2309 - DNA, 50 bp, Homo sapiens
tggaaattcccgtgttgcttcaaactgagacagatgggacttaacaggca

SEQ ID NO: 2310 - DNA, 50 bp, Homo sapiens; identical to SEQ ID NO: 2309

SEQ ID NO: 2311 - DNA, 50 bp, Homo sapiens
cgtcctgcggagccctgtctcctctctctgtaataaactcatttctagcc

SEQ ID NO: 2312 - DNA, 50 bp, Homo sapiens
tttccctgattatgatgagcttccattgttctgttaagtcttgaagagga

SEQ ID NO: 2313 - DNA, 50 bp, Homo sapiens
caaatgcaacctcacaaccttggctgagtcttgagactgaaagatttagc

SEQ ID NO: 2314 - DNA, 50 bp, Homo sapiens; identical to SEQ ID NO: 1862

SEQ ID NO: 2315 - DNA, 50 bp, Homo sapiens
tctgtcatgcccacaatccctttctaaggaagactgccctactatagcag

SEQ ID NO: 2316 - DNA, 50 bp, Homo sapiens
ggagaaataggaatttgtgaacccctaaaattgtagcaactttgaaaggt

SEQ ID NO: 2317 - DNA, 50 bp, Homo sapiens
acaagagtatccacaaaataggttggcactgactatatctctgcttgact

SEQ ID NO: 2318 - DNA, 50 bp, Homo sapiens
gccctcctgaaacttacacacaaaacgttaagtgatgaacattaaatagc

SEQ ID NO: 2319 - DNA, 50 bp, Homo sapiens
aaaccatctactatatgttagacatgacattctttttctctccttcctga

SEQ ID NO: 2320 - DNA, 50 bp, Homo sapiens
gtgtatctcgtggaatcagtggttagcattgccgctattatatttactca

SEQ ID NO: 2321 - DNA, 50 bp, Homo sapiens
ttgtgatgttaagaaatttgtatggtgtggcagtggtctattcctaagga

SEQ ID NO: 2322 - DNA, 50 bp, Homo sapiens
cggatgactgaccaagaggctattcaagatctctggcagtggaggaagtc

SEQ ID NO: 2323 - DNA, 50 bp, Homo sapiens
cctaaatctgtgtgtgtattgtgaagtggtataagaaatgactttgaacc

SEQ ID NO: 2324 - DNA, 50 bp, Homo sapiens
caggctgaggtggaccaagaaggcaaccaagtccccagaggagacccgcg

SEQ ID NO: 2325 - DNA, 50 bp, Homo sapiens
gaatgtagggaagaggtgccaagccaaccgtggggttagctctaattatt

SEQ ID NO: 2326 - DNA, 50 bp, Homo sapiens
acggggatgtcagggaggcaagtgtgttgtgttactgtgtcaataaactg

SEQ ID NO: 2327 - DNA, 50 bp, Homo sapiens
ggcagaatgggccaaaagcttagtgttgtgacctgtttttaaaataaagt

SEQ ID NO: 2328 - DNA, 50 bp, Homo sapiens
caagatggggtgggggatattgagggagacagcgctaaggatggttttat

SEQ ID NO: 2329 - DNA, 50 bp, Homo sapiens
taggcttctatttcctttccacccactcttcacaggctattctactttaa

SEQ ID NO: 2330 - DNA, 50 bp, Homo sapiens
ggtaaccaggtccaatcagtaaaaataagctgcttataactggaaatggc

SEQ ID NO: 2331 - DNA, 50 bp, Homo sapiens
tctgttttaagtaacagaattgataactgagcaaggaaacgtaatttgga

SEQ ID NO: 2332 - DNA, 50 bp, Homo sapiens
tgcctttaattgttctcataatgaagaataagtaggtaccctccatgccc

SEQ ID NO: 2333 - DNA, 50 bp, Homo sapiens
tgccattaagcaggaatgtcatgttccagttcattacaaaagaaaacaat

SEQ ID NO: 2334 - DNA, 50 bp, Homo sapiens
acctgttttgtatacctgagagcctgctatgttcttcttttgttgatcca

SEQ ID NO: 2335 - DNA, 50 bp, Homo sapiens
ctgcttccttcagtttgtaaagtcggtgattatatttttgggggctttcc

SEQ ID NO: 2336 - DNA, 50 bp, Homo sapiens
agcatacttcttttttccagtttcaatctaactgtgaaagaaacttctga

SEQ ID NO: 2337 - DNA, 50 bp, Homo sapiens
gaactctaacacttctctcctccactctgagccccctgaccttccaaacc

SEQ ID NO: 2338 - DNA, 50 bp, Homo sapiens
ccagtgcgtgctgtctgtggagtgtgtctcatgctttcagatgtgcatat

SEQ ID NO: 2339 - DNA, 50 bp, Homo sapiens
ccctgccacatgggtccagtgttcatctgagcataactgtactaaatcct

SEQ ID NO: 2340 - DNA, 50 bp, Homo sapiens
tgcttaaggcaagagtttcagatttactgttgaaataaacccaactgttc

SEQ ID NO: 2341 - DNA, 50 bp, Homo sapiens
cctgacccctcccatccttcccatttcctttgatgttattttgttacagc

SEQ ID NO: 2342 - DNA, 50 bp, Homo sapiens
taagtccctgctgcccttccccttcccacactgtccattcttcctcccat

SEQ ID NO: 2343 - DNA, 50 bp, Homo sapiens
tgatgtgattgtagctttttaaactatgaaacccctgagagattgtacct

SEQ ID NO: 2344 - DNA, 50 bp, Homo sapiens
cccaaaggttcctaagcctggctgcaaagaagaatcaacagggacacttt

SEQ ID NO: 2345 - DNA, 50 bp, Homo sapiens
tagaagtttgctttttccctgcctgtcttggtcactaccacctcttccct

SEQ ID NO: 2346 - DNA, 50 bp, Homo sapiens
tgaccagcactgtctcagtttcactttcacatagatgtccctttcttggc

SEQ ID NO: 2347 - DNA, 50 bp, Homo sapiens
ctgcccatctcagcctcaccatcaccctgctaatgactgccagactgtgg

SEQ ID NO: 2348 - DNA, 50 bp, Homo sapiens
ttcctgaagctgttcccactcccagatggttttatcaatagcctagaggt

SEQ ID NO: 2349 - DNA, 50 bp, Homo sapiens
ggattacctttccttgtaaagaggatgctgccttaagaattgcatgttgt

SEQ ID NO: 2350 - DNA, 50 bp, Homo sapiens
gggtctttggtgtttttaaatgattgtttcttcttcatgcttttgcttgc

SEQ ID NO: 2351 - DNA, 50 bp, Homo sapiens
catggggcgggggcgggaccagggagaattaataaagttctggacttttg

SEQ ID NO: 2352 - DNA, 50 bp, Homo sapiens
atttaaagcacagtttgtttttctgtcacctatagagtgcaagaatgcac

SEQ ID NO: 2353 - DNA, 50 bp, Homo sapiens
cagcactgtctccagataggaacatgcacaaagcagttaattaggcagcc

SEQ ID NO: 2354 - DNA, 50 bp, Homo sapiens
ctcccctcccattcctctggtccctgccttggtcccttgcctgggaagag

SEQ ID NO: 2355 - DNA, 50 bp, Homo sapiens
aaggttggttaaaagatggcagaaagaagatgaaaataaataagcctggt

SEQ ID NO: 2356 - DNA, 50 bp, Homo sapiens
ctcatcaccggttctgtgcctgtgctctgttgtgttggagggaaggactg

SEQ ID NO: 2357 - DNA, 50 bp, Homo sapiens
tttgcttggcaacacgacttgaaataaataaaactttgtttcttaggaga

SEQ ID NO: 2358 - DNA, 50 bp, Homo sapiens
aaaagaaatctgtttcaacagatgaccgtgtacaataccgtgtggtgaaa

SEQ ID NO: 2359 - DNA, 50 bp, Homo sapiens
gacgccacacaccattttcagatgccgttgcaattaaatcttgccacact

SEQ ID NO: 2360 - DNA, 50 bp, Homo sapiens
atgttttagtaacagttggctgtaatcactcctcgccgtgtctggcactg

SEQ ID NO: 2361 - DNA, 50 bp, Homo sapiens
agttctgcgtttggcatcttcactctttccaaaatgtatctgtacatcag

SEQ ID NO: 2362 - DNA, 50 bp, Homo sapiens
tgtgtttgcagagctagtggatgtgtttgtctacaagtatgattgctgtt

SEQ ID NO: 2363 - DNA, 50 bp, Homo sapiens
aaatctggggaagaggttttatttacattttagggtgggtaagaaagcca

SEQ ID NO: 2364 - DNA, 50 bp, Homo sapiens
cagagcggaggctgggatctagcgagagagatgcagaagatgtgaagaaa

SEQ ID NO: 2365 - DNA, 50 bp, Homo sapiens
cgtttggaggggcggtttctggtagttgtggcttttatgctttcaaagaa

SEQ ID NO: 2366 - DNA, 50 bp, Homo sapiens
ggggtgggagggatggggagtcggttagtcattgatagaactactttgaa

SEQ ID NO: 2367 - DNA, 50 bp, Homo sapiens
tgcagaaacagaaaggttttcttctttttgcttcaaaaacattcttacat

SEQ ID NO: 2368 - DNA, 50 bp, Homo sapiens
agattaactgctggacctcctacctgcattatctcattctggcttccttg

SEQ ID NO: 2369 - DNA, 50 bp, Homo sapiens
ctttgtggttttaaagacaactgtgaaataaaattgtttcaccgcctggt

SEQ ID NO: 2370 - DNA, 50 bp, Homo sapiens
gaactcagctgggttggtgaattaactaatggaagacatgaaattgttcc

SEQ ID NO: 2371 - DNA, 50 bp, Homo sapiens
acgatgatggttacccttcatggacgtcttaatcttccacacacatcccc

SEQ ID NO: 2372 - DNA, 50 bp, Homo sapiens
ttcagttctaataatgtccttaaattttatttccagctcctgttccttgg

SEQ ID NO: 2373 - DNA, 50 bp, Homo sapiens
gcctttccattccatttattcacactgagtgtcctacaataaacttccgt

SEQ ID NO: 2374 - DNA, 50 bp, Homo sapiens
tgcattatccagaactgaagttgccctacttttaactttgaacttggcta

SEQ ID NO: 2375 - DNA, 50 bp, Homo sapiens
gcccagtaagacactcatgtggctagtgtttgccgaatgaaactcaactc

SEQ ID NO: 2376 - DNA, 50 bp, Homo sapiens
taagtcttatgccaaattcagtgctactcctcgttacatgacatacaact

SEQ ID NO: 2377 - DNA, 50 bp, Homo sapiens
aagtgagtggacagcctttgtgtgtatctctccaataaagctctgtgggc

SEQ ID NO: 2378 - DNA, 50 bp, Homo sapiens
tctccaagtctttggttgaagagaagatatatgactgttgagtgtgctct

SEQ ID NO: 2379 - DNA, 50 bp, Homo sapiens
ggggaattgtcgcctcctgctcttttgttactgagtgagataaggttgtt

SEQ ID NO: 2380 - DNA, 50 bp, Homo sapiens; identical to SEQ ID NO: 1624

SEQ ID NO: 2381 - DNA, 50 bp, Homo sapiens
cgggcactgggtggggcagggcacgagttatttaaaacagttacactgca

SEQ ID NO: 2382 - DNA, 50 bp, Homo sapiens
cggacatcttttccgttgcggtttgagaatgttcctataataaacccctc

SEQ ID NO: 2383 - DNA, 50 bp, Homo sapiens
tttggcctgttttgatgtatgtgtgaaacaatgttgtccaacaataaaca

SEQ ID NO: 2384 - DNA, 50 bp, Homo sapiens
agcgagctgctctgctatgtccttaagccaatatttactcatcaggtcat

SEQ ID NO: 2385 - DNA, 50 bp, Homo sapiens
tgtagttggggtagattatgatttaggaagcaaaagtaagaagcagcatt

SEQ ID NO: 2386 - DNA, 50 bp, Homo sapiens
gcgatggacagactcacaacctgaacctaggagtgccccattcttttgta

SEQ ID NO: 2387 - DNA, 50 bp, Homo sapiens
gctcaggagggtacaagctccagaacagtaaccaagtgggaaaataaaga

SEQ ID NO: 2388 - DNA, 50 bp, Homo sapiens
ctggattcatgcagccagctttgcaggttatcagagatcaaagattgtaa

SEQ ID NO: 2389 - DNA, 50 bp, Homo sapiens; identical to SEQ ID NO: 1809

SEQ ID NO: 2390 - DNA, 50 bp, Homo sapiens
ctgtggaaaaatatttaagatagttttgccagaacagtttgtacagacgt

SEQ ID NO: 2391 - DNA, 50 bp, Homo sapiens
actctcaaataattaaaaaggactgtattgttgaacagagggacaattgt

SEQ ID NO: 2392 - DNA, 50 bp, Homo sapiens
aactcatgggaataattgtgagtcagcgtaacatttcaagagtctaaagg

SEQ ID NO: 2393 - DNA, 50 bp, Homo sapiens
tgctcctgttctgtcacttgtcatggtctttcttggtattaaaggccacc

SEQ ID NO: 2394 - DNA, 50 bp, Homo sapiens
ggggttgtaaatatcaactattcaacagtttaggatgcaattacgagtgt

SEQ ID NO: 2395 - DNA, 50 bp, Homo sapiens
aatcttatgtttccaagagaactaaagctggagagacctgacccttctct

SEQ ID NO: 2396 - DNA, 50 bp, Homo sapiens
tgcaccaggtgttggaaaaacacaattatggtaaaataaagtgttctcct

SEQ ID NO: 2397 - DNA, 50 bp, Homo sapiens
aatgggcacacagggaacaggaaatgggaatgagagcaagggttgggttg

SEQ ID NO: 2398 - DNA, 50 bp, Homo sapiens
tcttcttcatctctgttttgctcttaaaaatataaaaaggcaattccccg

SEQ ID NO: 2399 - DNA, 50 bp, Homo sapiens
agatgtaacccaccttgaccataaattggcttttcatagtgctcagatgt

SEQ ID NO: 2400 - DNA, 50 bp, Homo sapiens
ctaggctctgggcacatttcctgttcttgaattctgctcctgaagagggt

SEQ ID NO: 2401 - DNA, 50 bp, Homo sapiens
taccctgcccctctttttcggtttgtttttattctttcatttttacaagg

SEQ ID NO: 2402 - DNA, 50 bp, Homo sapiens
gctgcctaacttatccatctttgaacttctgactacttgttgtatctgct

SEQ ID NO: 2403 - DNA, 50 bp, Homo sapiens
cctttaaaacaataaggcgctttcattttgcactctaacttaagagtttt

SEQ ID NO: 2404 - DNA, 50 bp, Homo sapiens
tcctgcctcctgcggctgttggatttgggaatgaccttggtgagagtctc

SEQ ID NO: 2405 - DNA, 50 bp, Homo sapiens
atactctgagctgtggactgaactggcagacacaacctgtacagattgaa

SEQ ID NO: 2406 - DNA, 50 bp, Homo sapiens
aaggaattatgtggtcagtgcattgttttttaaactggaaatcattttgt

SEQ ID NO: 2407 - DNA, 50 bp, Homo sapiens
tgctcttaaaaccagggagtcagatatatttgtaaggttaaatcattggt

SEQ ID NO: 2408 - DNA, 50 bp, Homo sapiens
gccaaaaatctgtcttgaaggcagctacactttgaagtggtctttgaata

SEQ ID NO: 2409 - DNA, 50 bp, Homo sapiens; identical to SEQ ID NO: 651

SEQ ID NO: 2410 - DNA, 50 bp, Homo sapiens
tgactatctgtaatggatcaattttggatatgactttgggtgggggtaaa

SEQ ID NO: 2411 - DNA, 50 bp, Homo sapiens; identical to SEQ ID NO: 1839

SEQ ID NO: 2412 - DNA, 50 bp, Homo sapiens
ggtagtgcctccaggggcagaggaaaagaagaagtgttactgcattttgt

SEQ ID NO: 2413 - DNA, 50 bp, Homo sapiens
atggtcagattagatgcaagaataaagcagttgtccgagtctaagtttct

SEQ ID NO: 2414 - DNA, 50 bp, Homo sapiens
tggtattctgttctgaagtctaggatatttttcagcctataaagccccct

SEQ ID NO: 2415 - DNA, 50 bp, Homo sapiens
acttacccagatgttgcttttgaaaagttgaaatgtgtaattgttttgga

SEQ ID NO: 2416 - DNA, 50 bp, Homo sapiens
agcggactcaggctccagctgtggctacaacatagggtttttatacaaga

SEQ ID NO: 2417 - DNA, 50 bp, Homo sapiens
ttattgtggcaaatgttgtctgacttactgtttcaacaaaccagaagaca

SEQ ID NO: 2418 - DNA, 50 bp, Homo sapiens
tggacagtagcattagaattgtggaaaaggaacacgcaaagggagaagtg

SEQ ID NO: 2419 - DNA, 50 bp, Homo sapiens
ctggtaaattttgtgcttatcttcaaggctggcttaagtataaaattgtt

SEQ ID NO: 2420 - DNA, 50 bp, Homo sapiens
ccctggctccttcagacacgtgcttgatgctgagcaagttcaataaagat

SEQ ID NO: 2421 - DNA, 50 bp, Homo sapiens
gttaacttccaggagttcctcattctggtgataaagatgggctggcagcc

SEQ ID NO: 2422 - DNA, 50 bp, Homo sapiens
cctgtctcgtggcaacaaggctatgttctgttaggagttaccttaaactg

SEQ ID NO: 2423 - DNA, 50 bp, Homo sapiens
agtcagatctttctccttgaatatctttcgataaacaacaaggtggtgtg

SEQ ID NO: 2424 - DNA, 50 bp, Homo sapiens; identical to SEQ ID NO: 1861

SEQ ID NO: 2425 - DNA, 50 bp, Homo sapiens
ccacgggtgatgcttccaggggttctggcgggagtctcagccgaagagag

SEQ ID NO: 2426 - DNA, 50 bp, Homo sapiens; identical to SEQ ID NO: 150

SEQ ID NO: 2427 - DNA, 50 bp, Homo sapiens
accagactgacaaatgtgtatcggatgcttttgttcagggctgtgatcgg

SEQ ID NO: 2428 - DNA, 50 bp, Homo sapiens; identical to SEQ ID NO: 1685

SEQ ID NO: 2429 - DNA, 50 bp, Homo sapiens
cgaagaagagccacagtgagggagatcccatccccttgtctgaactggag

SEQ ID NO: 2430 - DNA, 50 bp, Homo sapiens
gacctgatacggctccccagtacaccccacctcttccttgtaaatatgat

SEQ ID NO: 2431 - DNA, 50 bp, Homo sapiens
ctcaagcgtcctgggatctccttctccctcctgtcctgtccttgcccctc

SEQ ID NO: 2432 - DNA, 50 bp, Homo sapiens
cctcaagggaggagtgatcttcaccaccaagaagggccagcagttctgtg

SEQ ID NO: 2433 - DNA, 50 bp, Homo sapiens
tcctgtgtgtcatgttggtttttggtacttgtattgtcatttggagaaac

SEQ ID NO: 2434 - DNA, 50 bp, Homo sapiens
tcctgtgatggaaatacaactggtatcttcacttttttaggaattgggaa

SEQ ID NO: 2435 - DNA, 50 bp, Homo sapiens
aatttgcagtaaacttttaattaaatgctcatctggtaactcaacacccc

SEQ ID NO: 2436 - DNA, 50 bp, Homo sapiens
gctgcttttgaggagaaaatatatagctttggacacgaggaagatctaga

SEQ ID NO: 2437 - DNA, 50 bp, Homo sapiens
aaacgcttggagtgcttctgaatatacagaagttccatttaagggcaagt

SEQ ID NO: 2438 - DNA, 50 bp, Homo sapiens
tgcatcgtgtttctacctttagtaccttgccactcttttaaaacgctgct

SEQ ID NO: 2439 - DNA, 50 bp, Homo sapiens; identical to SEQ ID NO: 196

SEQ ID NO: 2440 - DNA, 50 bp, Homo sapiens
agacctttctttgggactgtgtggaccaaggagcttccatctagtgacaa

SEQ ID NO: 2441 - DNA, 50 bp, Homo sapiens
gctcagtaacataactgcttcttggagctttggaatattttatcctgtat

SEQ ID NO: 2442 - DNA, 50 bp, Homo sapiens; identical to SEQ ID NO: 1855

SEQ ID NO: 2443 - DNA, 50 bp, Homo sapiens
cgggccttgcatataaataacggagcatacagtgagcacatctagctgat

SEQ ID NO: 2444 - DNA, 50 bp, Homo sapiens
agagatgcctttgtttgatgagattcaaacttgatgctatgctttaaaat

SEQ ID NO: 2445 - DNA, 50 bp, Homo sapiens
agtcccattcttccttttcaatacctacccccaaatcttctcctaaccct

SEQ ID NO: 2446 - DNA, 50 bp, Homo sapiens
tgtcacactggctatcaaagaataagaaaattattgagtatgagtgtgtt

SEQ ID NO: 2447 - DNA, 50 bp, Homo sapiens
gcaaaacccagaagctaaaaagtcaataaacagaaagaatgattttgaga

SEQ ID NO: 2448 - DNA, 50 bp, Homo sapiens
ttgtgaccaaatgggcctcaaagattcagattgaaacaaacaaaaagctt

SEQ ID NO: 2449 - DNA, 50 bp, Homo sapiens
aaggttctattaaccacttctaagggtacacctccctccaaactactgca

SEQ ID NO: 2450 - DNA, 50 bp, Homo sapiens
gttgtatcacccccgagttagcatatcccaggctcgcagactcaacacag

SEQ ID NO: 2451 - DNA, 50 bp, Homo sapiens
ccacttgagtttgtcctccaagggtaggtgtctcatttgttctggcccct

SEQ ID NO: 2452 - DNA, 50 bp, Homo sapiens
tcctgtctctctcctccttactcttggataaataaacagcctgtgagcac

SEQ ID NO: 2453 - DNA, 50 bp, Homo sapiens
cctgaccctctttgaattaagtggactgtggcatgacattctgcaatact

SEQ ID NO: 2454 - DNA, 50 bp, Homo sapiens
tctaaactttattttcaaaagcttaaggcccaaatacaaacttctctgga

SEQ ID NO: 2455 - DNA, 50 bp, Homo sapiens
catggtgatagcctgaaagagctttcctcactagaaaccaaatggtgtaa

SEQ ID NO: 2456 - DNA, 50 bp, Homo sapiens
ggagaaggattagaaagttatgtggcagataaagaattccatgcacctct

SEQ ID NO: 2457 - DNA, 50 bp, Homo sapiens
acagtttttcttttgaatttagtatttgagatgagttgttgggacatgca

SEQ ID NO: 2458 - DNA, 50 bp, Homo sapiens
gatctagtctgttacaccatttagaactttcctcagccattatcagtcat

SEQ ID NO: 2459 - DNA, 50 bp, Homo sapiens
agcatggtaagttcccttagctatatgaattttggcatgtttcagagaga

SEQ ID NO: 2460 - DNA, 50 bp, Homo sapiens
acatttttattctttctactgagggcattgtctgttttctttgtaaatgc

SEQ ID NO: 2461 - DNA, 50 bp, Homo sapiens
aaaaggaaaaccgaattaggtccacttcaatgtccacctgtgagaaagga

SEQ ID NO: 2462 - DNA, 50 bp, Homo sapiens
cctatccccggatgtgtgagaataatgtgttcataaagcatggatctcgt

SEQ ID NO: 2463 - DNA, 50 bp, Homo sapiens
ccagtgtctattctgggttagagaagtgcttactaaggggttttctaata

SEQ ID NO: 2464 - DNA, 50 bp, Homo sapiens
gggtgatctgcttttatctaaatgcaaataaggatgtgttctctgagacc

SEQ ID NO: 2465 - DNA, 50 bp, Homo sapiens; identical to SEQ ID NO: 1748

SEQ ID NO: 2466 - DNA, 50 bp, Homo sapiens
gagccaatccactccttcctttctatcattcccctgcccacctccttcca

SEQ ID NO: 2467 - DNA, 50 bp, Homo sapiens; identical to SEQ ID NO: 184

SEQ ID NO: 2468 - DNA, 50 bp, Homo sapiens
gctgctgccaccgcttcctgcctgtcatttgaataaacagtgtttctatt

SEQ ID NO: 2469 - DNA, 50 bp, Homo sapiens
tgggactcatccaaaagggacgagaagaaagaagaaggaacctgattcgg

SEQ ID NO: 2470 - DNA, 50 bp, Homo sapiens
tcaagactgcctttatgctggatcatgtgctactggtataaagttctggc

SEQ ID NO: 2471 - DNA, 50 bp, Homo sapiens
gtacacccctcaaccctatgcagcctggagtgggcatcaataaaatgaac

SEQ ID NO: 2472 - DNA, 50 bp, Homo sapiens
ccatgagactgatccctggccactgaaaagctttcctgacaataaaaatg

SEQ ID NO: 2473 - DNA, 50 bp, Homo sapiens
ttgggaagtgaccatttctaggcttatacataatagcaataataaaggct

SEQ ID NO: 2474 - DNA, 50 bp, Homo sapiens
atgtggtaaaacccagaaagcatccatcatgaatgcaagatactttcaat

SEQ ID NO: 2475 - DNA, 50 bp, Homo sapiens
ttcacattgtattcagagttgatggttgtacatataagtgattgctggtt

SEQ ID NO: 2476 - DNA, 50 bp, Homo sapiens
gccactggtttctcagaatccaaagatcacatattctagtgtaacactgc

SEQ ID NO: 2477 - DNA, 50 bp, Homo sapiens
ctgtgctttttgcttgggataatggagtttttctttagaaacagtgccaa

SEQ ID NO: 2478 - DNA, 50 bp, Homo sapiens
tatcagactagtgacaagctcctggtcttgagatgtcttctcgttaagga

SEQ ID NO: 2479 - DNA, 50 bp, Homo sapiens
agggcttgaggtgaatttcattaaatggaataatatgatgccactttgca

SEQ ID NO: 2480 - DNA, 50 bp, Homo sapiens
ttgacctcccatttttactatttgccaatacctttttctaggaatgtgct

SEQ ID NO: 2481 - DNA, 50 bp, Homo sapiens
agcgggaaggattttgggtaaatctgagagctgcgataaagtcctaggtt

SEQ ID NO: 2482 - DNA, 50 bp, Homo sapiens
tgatgtttgatggacctatgaatctatttagggagacacagatggctggg

SEQ ID NO: 2483 - DNA, 50 bp, Homo sapiens
agccctgaggatgaacaacctcagagaagaggtggtttagagcaaggaaa

SEQ ID NO: 2484 - DNA, 50 bp, Homo sapiens; identical to SEQ ID NO: 1844

SEQ ID NO: 2485 - DNA, 50 bp, Homo sapiens; identical to SEQ ID NO: 1453

SEQ ID NO: 2486 - DNA, 50 bp, Homo sapiens
gcgggggtggacagggaggcagcttgtgaatttttgttttactgtttaac

SEQ ID NO: 2487 - DNA, 50 bp, Homo sapiens
aacttcagatacttgtgaacatgccttatatttgtccaacaactgtcaga

SEQ ID NO: 2488 - DNA, 50 bp, Homo sapiens
gaagggttggcctgcctggctggggaggtcagtaaactttgaatagtaag

SEQ ID NO: 2489 - DNA, 50 bp, Homo sapiens
aagatgtacccttcaggtgaacctggtatcagacccacagtacttgctgt

SEQ ID NO: 2490 - DNA, 50 bp, Homo sapiens; identical to SEQ ID NO: 1733

SEQ ID NO: 2491 - DNA, 50 bp, Homo sapiens
agtggaatgttctatccccacaagaaggattatatcttatagacttgtct

SEQ ID NO: 2492 - DNA, 50 bp, Homo sapiens
cccgtggccctggagcctcaataaagtgtccctttcattgactggagcag

SEQ ID NO: 2493 - DNA, 50 bp, Homo sapiens
ttatgcatttatcacttccaaatctaactttgcacaagtaacccatgtaa

SEQ ID NO: 2494 - DNA, 50 bp, Homo sapiens
tccgcactatataattcgcacacattaattagggtttatgtaccatacaa

SEQ ID NO: 2495 - DNA, 50 bp, Homo sapiens
gcttgtgaccattttgtatggcttgtctggaaacttctgtaaatcttatg

SEQ ID NO: 2496 - DNA, 50 bp, Homo sapiens
tgctgatttatgcaaagggctggcattctgatgcttttcaggtttaatcc

SEQ ID NO: 2497 - DNA, 50 bp, Homo sapiens
tgcattctggcagttcttttaggattataggttgcaaattatccaaatat

SEQ ID NO: 2498 - DNA, 50 bp, Homo sapiens
ccgacagcccagcctagcccacttgtcatccataaagcaagctcaacctt

SEQ ID NO: 2499 - DNA, 50 bp, Homo sapiens
tttgctgttagtcgggttagagttggctctacgcgaggtttgttaataaa

SEQ ID NO: 2500 - DNA, 50 bp, Homo sapiens
cagactgctagtgttctgtctaaaaaccagacaaggaaatacccttcttt

SEQ ID NO: 2501 - DNA, 50 bp, Homo sapiens
ttttccagtgaggtaaaataaggcataaatgcaggtaattattcccagct

SEQ ID NO: 2502 - DNA, 50 bp, Homo sapiens
ccggcacttctagtggtctcacctggaggcaagagggagggtacagagcc

SEQ ID NO: 2503 - DNA, 50 bp, Homo sapiens; identical to SEQ ID NO: 1701

SEQ ID NO: 2504 - DNA, 50 bp, Homo sapiens; identical to SEQ ID NO: 1264

SEQ ID NO: 2505 - DNA, 50 bp, Homo sapiens
tttccagcaagtatccaaccaacttggttctgcttcaataaatctttgga

SEQ ID NO: 2506 - DNA, 50 bp, Homo sapiens
atgacttgcatcccagctttccaccaaccaaattcaaacattcactgctt

SEQ ID NO: 2507 - DNA, 50 bp, Homo sapiens
tgtatgagactttttgttgcaaaggacacatttatcatattcattcacac

SEQ ID NO: 2508 - DNA, 50 bp, Homo sapiens
tgatctgtccagtgtcactctgtaccctcaacatatatcccttgtgcgat

SEQ ID NO: 2509 - DNA, 50 bp, Homo sapiens
aattcacccctcccacctctttcttcaattaatggaaaagcgttaaggga

SEQ ID NO: 2510 - DNA, 50 bp, Homo sapiens
ctcagtactttgcagaaaacaccaaacaaaaatgccattttaaaaaaggt

SEQ ID NO: 2511 - DNA, 50 bp, Homo sapiens
agccttcagtcagagctcaaaccttagtcaacaccagagaattcacatga

SEQ ID NO: 2512 - DNA, 50 bp, Homo sapiens
aaccctctaagaatacctgtttaagtcttgagtgttgaaaggaattgttt

SEQ ID NO: 2513 - DNA, 50 bp, Homo sapiens; identical to SEQ ID NO: 652

SEQ ID NO: 2514 - DNA, 50 bp, Homo sapiens
tcaggagtgggttgatttcagcacctacagtgtacagtcttgtattaagt

SEQ ID NO: 2515 - DNA, 50 bp, Homo sapiens
ccttcagttatactttcaatgaccttttgtgcatctgttaaggcaaaaca

SEQ ID NO: 2516 - DNA, 50 bp, Homo sapiens
aagtgaacaaaataagcaactaaatgagacctaataattggccttcgatt

SEQ ID NO: 2517 - DNA, 50 bp, Homo sapiens
cacaaccaaatttgatgcgatctgctcagtaatataatttgccattttta

SEQ ID NO: 2518 - DNA, 50 bp, Homo sapiens
acattgtaatagaaacagatttcccaaattccagcctggcatgaggtaat

SEQ ID NO: 2519 - DNA, 50 bp, Homo sapiens
cagactgaatagatcttaactgtctcctacatgtgtgttttcaaatgtgt

SEQ ID NO: 2520 - DNA, 50 bp, Homo sapiens
gatatcccagcggtggtacttcggagacacctgtctgcatctgactgagc

SEQ ID NO: 2521 - DNA, 50 bp, Homo sapiens
acactttcctctgcctttttctcttatatgtgggttcatggttcagttcg

SEQ ID NO: 2522 - DNA, 50 bp, Homo sapiens
agataatgtcaccagtcctcttccttcacttcttgttgtaattgcagcca

SEQ ID NO: 2523 - DNA, 50 bp, Homo sapiens
ccggcacacagggactaggtctagtgagaacatcaggagcagccagggat

SEQ ID NO: 2524 - DNA, 50 bp, Homo sapiens
catcgggttttgggtgtgtgttttcatagcgtggttactttctataatgc

SEQ ID NO: 2525 - DNA, 50 bp, Homo sapiens
atgtatttctttctgactagacttgtgatatgcgtgtgtttatgtacaga

SEQ ID NO: 2526 - DNA, 50 bp, Homo sapiens
gttctgtatcagttgaatttttgtgctcttttccctgtgtacgtggtggt

SEQ ID NO: 2527 - DNA, 50 bp, Homo sapiens
catttatgagttccatgatatgtggtctaagaaagaccaaacagatttct

SEQ ID NO: 2528 - DNA, 50 bp, Homo sapiens
aaatcggttgggtaccatgctttttctccccttcacgtttgcagttgatg

SEQ ID NO: 2529 - DNA, 50 bp, Homo sapiens
gttcatgttggaaagaatgaaaacaacttcaagttcataggcagccagcc

SEQ ID NO: 2530 - DNA, 50 bp, Homo sapiens
tgtcatttaaagacatcaggttcatctgtttactgagctagaaacatagt

SEQ ID NO: 2531 - DNA, 50 bp, Homo sapiens
atctggtgccaaatgaagatttttaggagtgattactaattatcaagggc

SEQ ID NO: 2532 - DNA, 50 bp, Homo sapiens
ttctgcactgggaggtgtaatacatcacaaagacaaagaaaacgcatact

SEQ ID NO: 2533 - DNA, 50 bp, Homo sapiens
agttgaaggaaaatgttcatgttcatatgtacttgtttgctatgactaca

SEQ ID NO: 2534 - DNA, 50 bp, Homo sapiens
cactggggaagtcaagaatggggcctggggctctcagggagaactgcttc

SEQ ID NO: 2535 - DNA, 50 bp, Homo sapiens
ccctagatacagcagtttatacccacacacctgtctacagtgtcattcaa

SEQ ID NO: 2536 - DNA, 50 bp, Homo sapiens
gaaagtgcttagctctctccctcctgacctctgggcagccagtcatcaaa

SEQ ID NO: 2537 - DNA, 50 bp, Homo sapiens
atcatgtatgcaatactttccccctttttgctttgctaaccaaagagcat

SEQ ID NO: 2538 - DNA, 50 bp, Homo sapiens
ctgctgtctcttcagtctgctccatccatcacccatttacccatctctca

SEQ ID NO: 2539 - DNA, 50 bp, Homo sapiens
tatagaaaatgtacagttgtgtgaatgtgaaataaatgtcctcaactccc

SEQ ID NO: 2540 - DNA, 50 bp, Homo sapiens
ggccgtgttcaaagagcaatattccagtaaatgcagactgctgcaaagct

SEQ ID NO: 2541 - DNA, 50 bp, Homo sapiens; identical to SEQ ID NO: 689

SEQ ID NO: 2542 - DNA, 50 bp, Homo sapiens
gaactgacttcaaaggcagcttctggacaggtggtgggaggggacccttc

SEQ ID NO: 2543 - DNA, 50 bp, Homo sapiens
ggagaggctctgtttccagccagttagttttctctgggagacttctctgt

SEQ ID NO: 2544 - DNA, 50 bp, Homo sapiens
tttctattccatacttctgcccacgttgttttctctcaaaatccattcct

SEQ ID NO: 2545 - DNA, 50 bp, Homo sapiens
cctgtacacagccgagcagcatttccgttgaaggacttgcatccccattg

SEQ ID NO: 2546 - DNA, 50 bp, Homo sapiens
ttgatgcttagtggaatgtgtgtctaacttgctctctgacatttagcaga

SEQ ID NO: 2547 - DNA, 50 bp, Homo sapiens
aagaagttaacatgaactcttgaagtcacaccagggcaactcttggaaga

SEQ ID NO: 2548 - DNA, 50 bp, Homo sapiens
ggtggatctccaaccaggccagagaagattctcacagaaggttttgaact

SEQ ID NO: 2549 - DNA, 50 bp, Homo sapiens; identical to SEQ ID NO: 63

SEQ ID NO: 2550 - DNA, 50 bp, Homo sapiens
ggttcgctctactatggagatcaacagttactgtgactgagtcggcccat

SEQ ID NO: 2551 - DNA, 50 bp, Homo sapiens
gctcacactcagcgtgggaccccgaatgttaagcaatgataataaagtat

SEQ ID NO: 2552 - DNA, 50 bp, Homo sapiens
ctgctcgcccctatcgctccagccaaggcgaagaagcacgaacgaatgtc

SEQ ID NO: 2553 - DNA, 50 bp, Homo sapiens
acctgccaccatgttttgtaatttgaggtcttgatttcaccattgtcggt

SEQ ID NO: 2554 - DNA, 50 bp, Homo sapiens
aacgaaaggaagttctgttggaagcatctgaagaaactggaaagagggtt

SEQ ID NO: 2555 - DNA, 50 bp, Homo sapiens
acatttacctgaatgttgtctgaggactgaactgtggactttactattca

SEQ ID NO: 2556 - DNA, 50 bp, Homo sapiens
aaatccagctgcagaaacagacaccccaatgctatttacatacagctcta

SEQ ID NO: 2557 - DNA, 50 bp, Homo sapiens
ccccgttcctcacttttcccttttcattcccaccccctagactttgattt

SEQ ID NO: 2558 - DNA, 50 bp, Homo sapiens
ttcaggcactaagaggggctggacctggcggcaggaagccaaagagactg

SEQ ID NO: 2559 - DNA, 50 bp, Homo sapiens
cgcaacaatccatctctcaagtagtgtatcacagtagtagcctccaggtt

SEQ ID NO: 2560 - DNA, 50 bp, Homo sapiens
cccaggctagggggctatagaaacatctagaaatagactgaaagaaaatc

SEQ ID NO: 2561 - DNA, 50 bp, Homo sapiens
acctacaaaaaagttactgtggtatctatgagttatcatcttagctgtgt

SEQ ID NO: 2562 - DNA, 50 bp, Homo sapiens
tggtgtttagtggataccacatcggaagtgattttctaaattggatttga

SEQ ID NO: 2563 - DNA, 50 bp, Homo sapiens
tcactatctttctgataacagaattgccaaggcagcgggatctcgtatct

SEQ ID NO: 2564 - DNA, 50 bp, Homo sapiens
gaaaagatggagaaaatgaacaggacatggggctcctggaaagaaagggc

SEQ ID NO: 2565 - DNA, 50 bp, Homo sapiens
gtggttttaggatgtcattctttgcagttcttcatcatgagacaagtctt

SEQ ID NO: 2566 - DNA, 50 bp, Homo sapiens
aagggtgaggatgagaagtggtcacgggatttattcagccttggtcagag

SEQ ID NO: 2567 - DNA, 50 bp, Homo sapiens
gagaagattcaggacctcttggtggactctggaaagttcatctacttaga

SEQ ID NO: 2568 - DNA, 50 bp, Homo sapiens
agtacaactggaagccaaaacaaggtggaagatgtcctgaattaagacgt

SEQ ID NO: 2569 - DNA, 50 bp, Homo sapiens
gttgctggcctaatgagcaatgttctcaattttcgttttcattttgctgt

SEQ ID NO: 2570 - DNA, 50 bp, Homo sapiens
acagacctccagaggggacttatggaaaagctgacacctaagtttaccaa

SEQ ID NO: 2571 - DNA, 50 bp, Homo sapiens; identical to SEQ ID NO: 1736

SEQ ID NO: 2572 - DNA, 50 bp, Homo sapiens
tggctttatgtccattttaccactgtttttatccaataaactaagtcggt

SEQ ID NO: 2573 - DNA, 50 bp, Homo sapiens; identical to SEQ ID NO: 688

SEQ ID NO: 2574 - DNA, 50 bp, Homo sapiens
cctttaaggttggaactttgaagttggagaaggtggaataaagttacacc

SEQ ID NO: 2575 - DNA, 50 bp, Homo sapiens
tgccttcgggttgtgctttagtctgtaaaattctaaaggagagctgctaa

SEQ ID NO: 2576 - DNA, 50 bp, Homo sapiens
gcaaaaacctgggaccagcccccttctcccacaaataaagcccaataaag

SEQ ID NO: 2577 - DNA, 50 bp, Homo sapiens
gtcatcggctttcagagggagaccacgggaatgttcagggaaacaatgtc

SEQ ID NO: 2578 - DNA, 50 bp, Homo sapiens
tgaattgcctgttcagggttccttatgcagagaaataaagcagattcagg

SEQ ID NO: 2579 - DNA, 50 bp, Homo sapiens
accaaccacctttccagccatagagattttaattagcccaactagaagcc

SEQ ID NO: 2580 - DNA, 50 bp, Homo sapiens
ctactttgtatgatgaccctgtcctccctcacccaggctgcagtgccatg

SEQ ID NO: 2581 - DNA, 50 bp, Homo sapiens
aaagaggagtggtttgtgacaagcggaatccaaatggcattcgagtggct

SEQ ID NO: 2582 - DNA, 50 bp, Homo sapiens
gaagagccatctcaacagaatcgcaccaaactatactttcaggatgaatt

SEQ ID NO: 2583 - DNA, 50 bp, Homo sapiens
tctgggttgtagagaactctttgtaagcaataaagtttggggtgatgaca

SEQ ID NO: 2584 - DNA, 50 bp, Homo sapiens
ctgctgtccactttccttcaggctctgtgaatacttcaacctgctgtgat

SEQ ID NO: 2585 - DNA, 50 bp, Homo sapiens
gcacctgctccaaaggcatctggcaagaaagcataagtggcaatcataaa

SEQ ID NO: 2586 - DNA, 50 bp, Homo sapiens; identical to SEQ ID NO: 1657

SEQ ID NO: 2587 - DNA, 50 bp, Homo sapiens
agctgccagaaagcacagatttgacccaagctatttatatgttataaagt

SEQ ID NO: 2588 - DNA, 50 bp, Homo sapiens; identical to SEQ ID NO: 1829

SEQ ID NO: 2589 - DNA, 50 bp, Homo sapiens
gatgaggctgacaaagttggggctgagaacacaatcacctattcacttct

SEQ ID NO: 2590 - DNA, 50 bp, Homo sapiens
tcctgcccccgccctgctgtatgatattaatgtggaaggtcatcaataaa

SEQ ID NO: 2591 - DNA, 50 bp, Homo sapiens
aaactgtaaatcataatgtaactgaagcataaacatcacatggcatgttt

SEQ ID NO: 2592 - DNA, 50 bp, Homo sapiens
acaaggacgctggctactgtctattaaaattctgatgtttctgtgaaatt

SEQ ID NO: 2593 - DNA, 50 bp, Homo sapiens
cttccttatggagctggagcagcccgcctagaacccagtctaatgagaac

SEQ ID NO: 2594 - DNA, 50 bp, Homo sapiens
tgcatctcattttgcctaaattggttctgtattcataaacactttccaca

SEQ ID NO: 2595 - DNA, 50 bp, Homo sapiens
agtgaagtctatgatgtgaaacactttgcctcctgtgtactgtgtcataa

SEQ ID NO: 2596 - DNA, 50 bp, Homo sapiens
ttgatgatgtaacttgaccttccagagttatggaaattttgtccccatgt

SEQ ID NO: 2597 - DNA, 50 bp, Homo sapiens
agctcacacgttccacccactgtccctcaaacaatgtcatttcagaaaga

SEQ ID NO: 2598 - DNA, 50 bp, Homo sapiens
ggaccacttttatttattgtcagacacttatttattgggatgtgagcccc

SEQ ID NO: 2599 - DNA, 50 bp, Homo sapiens
gggctgtacccaagctgatttctcatctggtcaataaagctgtttagacc

SEQ ID NO: 2600 - DNA, 50 bp, Homo sapiens
gctctgagggaaacgctgtctgctgccttcatacagatgctgattaaagt

SEQ ID NO: 2601 - DNA, 50 bp, Homo sapiens
ttttagctcaggaaaatatgtcaggctcaaaccacttctcaggcagttta

SEQ ID NO: 2602 - DNA, 50 bp, Homo sapiens
ttgttgaaccataaagtttgcaaagtaaaggttaagtatgaggtcaatgt

SEQ ID NO: 2603 - DNA, 50 bp, Homo sapiens
tgtggtttcagtctctgctagttcatattgcatgtttattttggacagtc

SEQ ID NO: 2604 - DNA, 50 bp, Homo sapiens
agcagaaattttgaagccagaaggacaacatatgaagcttaggagtgaag

SEQ ID NO: 2605 - DNA, 50 bp, Homo sapiens
actgcttcatctccttttgcgcttatttggaaattttagttatagtgttt

SEQ ID NO: 2606 - DNA, 50 bp, Homo sapiens
gagagagtacgggctcagcagccagaggaggccggtgaagtgcatcttct

SEQ ID NO: 2607 - DNA, 50 bp, Homo sapiens
cccagtcaccctcttggagcttccctgctttgaattaaagaccactcatg

SEQ ID NO: 2608 - DNA, 50 bp, Homo sapiens; identical to SEQ ID NO: 2607

SEQ ID NO: 2609 - DNA, 50 bp, Homo sapiens
ggagcgtggcacttacctttgtcccttgcttcattcttgtgagatgataa

SEQ ID NO: 2610 - DNA, 50 bp, Homo sapiens
gcatacacatgcactcagtgtggactgggaagcattactttgtagatgta

SEQ ID NO: 2611 - DNA, 50 bp, Homo sapiens
aagcctcaccattgacttcttccccccatcctcagacattaaagagcctg

SEQ ID NO: 2612 - DNA, 50 bp, Homo sapiens
ctgacctcggcccagcttggactgcacatctggcagctgaggagtcagtg

SEQ ID NO: 2613 - DNA, 50 bp, Homo sapiens
ggaagatcattaaggacggtgagcagcatgaagatctcaatgaagtagcc

SEQ ID NO: 2614 - DNA, 50 bp, Homo sapiens
ttacctctgtcttggctttcatgttattaaacgtatgcatgtgaagaagg

SEQ ID NO: 2615 - DNA, 50 bp, Homo sapiens
agttactggtctctttctgccgaatgttatgttttgcttttatctcacag

SEQ ID NO: 2616 - DNA, 50 bp, Homo sapiens
cacaaagtggcctttggggagaaagtcatgtatttgttcgcaattatgct

SEQ ID NO: 2617 - DNA, 50 bp, Homo sapiens
atttactccaagtcctctccccagctaccaccagtcccttactctgttct

SEQ ID NO: 2618 - DNA, 50 bp, Homo sapiens
gcccatccctgagccaggtaccaccattgtaaggaaacactttcagaaat

SEQ ID NO: 2619 - DNA, 50 bp, Homo sapiens
aggaccgacgcttctggagaaaatacctgcacctgagcttccatgccctg

SEQ ID NO: 2620 - DNA, 50 bp, Homo sapiens
ttcacaaagatttgcgttaatgaagactacacagaaaacctttctaggga

SEQ ID NO: 2621 - DNA, 50 bp, Homo sapiens
atacctgactttagagagagtaaaatgtgccaggagccataggaatatct

SEQ ID NO: 2622 - DNA, 50 bp, Homo sapiens; identical to SEQ ID NO: 679

SEQ ID NO: 2623 - DNA, 50 bp, Homo sapiens
acatccagaaagaaggacacttgtatgctagtctatggtcagttgaggaa

SEQ ID NO: 2624 - DNA, 50 bp, Homo sapiens
ttgactagtaaaagttactgcctagtctttttaccttaggcttacagaat

SEQ ID NO: 2625 - DNA, 50 bp, Homo sapiens
ttgcccaggccagttagaaaatcccttggggaactgtgatgaatattcca

SEQ ID NO: 2626 - DNA, 50 bp, Homo sapiens
ataatcacagttgtgttcctgacactcaataaacagtcactggaaagagt

SEQ ID NO: 2627 - DNA, 50 bp, Homo sapiens
tgaccggattccctcactgttgtatcttgaataaacgctgctgcttcatc

SEQ ID NO: 2628 - DNA, 50 bp, Homo sapiens
ccaaagttggagcttctattgccatgaaccatgcttacaaagaaagcact

SEQ ID NO: 2629 - DNA, 50 bp, Homo sapiens
gtgaactcctgcactggcatttggatgtgtgttaatgctatttgttttgt

SEQ ID NO: 2630 - DNA, 50 bp, Homo sapiens
gctgggtggaaactgctttgcactatcgtttgcttggtgtttgtttttaa

SEQ ID NO: 2631 - DNA, 50 bp, Homo sapiens
gcttgttatcagctttcagggccatggttcacattagaataaaaggtagt

SEQ ID NO: 2632 - DNA, 50 bp, Homo sapiens
ctttgccttgcagccacatggccccatcccagttggggaagccaggtgag

SEQ ID NO: 2633 - DNA, 50 bp, Homo sapiens
tgcgggttattgatttgttctttacaactattgttctcatatttctcaca

SEQ ID NO: 2634 - DNA, 50 bp, Homo sapiens
agttattagttctgctttagctttccaatatgctgtatagcctttgtcat

SEQ ID NO: 2635 - DNA, 50 bp, Homo sapiens
gctgttttcaacattgtatttggactatgcatgtgttttttccccattgt

SEQ ID NO: 2636 - DNA, 50 bp, Homo sapiens
aagtaaatgtacagtgatttgaaatacaataatgaaggcaatgcatggcc

SEQ ID NO: 2637 - DNA, 50 bp, Homo sapiens; identical to SEQ ID NO: 1636

SEQ ID NO: 2638 - DNA, 50 bp, Homo sapiens
tcttaagcaggtttgttttcagcactgatggaaaataccagtgttgggtt

SEQ ID NO: 2639 - DNA, 50 bp, Homo sapiens
ggggttggaaacttagcactttatatttatacagaacattcaggatttgt

SEQ ID NO: 2640 - DNA, 50 bp, Homo sapiens
acccgtgtgaatgtgaagaaaagcagtatgttactggttgttgttgttgt

SEQ ID NO: 2641 - DNA, 50 bp, Homo sapiens
ttgcactgtgagcaaatgctaatacagtaaatatattgtgtttgctgaca

SEQ ID NO: 2642 - DNA, 50 bp, Homo sapiens
aaatgaagtcacacaggacaattattcttatgcctaagttaacagtggat

SEQ ID NO: 2643 - DNA, 50 bp, Homo sapiens
gtcgctgcatatgtgactgtcatgagatcctacttagtatgatcctggct

SEQ ID NO: 2644 - DNA, 50 bp, Homo sapiens
aaggacaaaagttgttgccttcctaagaaccttctttaataaactcattt

SEQ ID NO: 2645 - DNA, 50 bp, Homo sapiens
ctgcattttgattctgaaaagaaagctggctttgcccatttcttattaaa

SEQ ID NO: 2646 - DNA, 50 bp, Homo sapiens
acctgtctgcataataaagctgatcatgttttgctacagtttgcaggtga

SEQ ID NO: 2647 - DNA, 50 bp, Homo sapiens
tactggtagatgtgctcattctccctgaaacatacccatcatattgtcct

SEQ ID NO: 2648 - DNA, 50 bp, Homo sapiens
aggaagcaatgtggttggacctggttaagggaaaggctgattacggaaat

SEQ ID NO: 2649 - DNA, 50 bp, Homo sapiens
aactaatactttgctgttgaaatgttgtgaaatgttaagtgtctggaaat

SEQ ID NO: 2650 - DNA, 50 bp, Homo sapiens
gagctttgtcacttgccacatggtgtcttccaacatgggagggatcagcc

SEQ ID NO: 2651 - DNA, 50 bp, Homo sapiens
ccctgttcactctacttagcatgtccctaccgagtctcttctccactgga

SEQ ID NO: 2652 - DNA, 50 bp, Homo sapiens
tgcacattgtttttcttctgacttccagaaataaaagtgtttccatggga

SEQ ID NO: 2653 - DNA, 50 bp, Homo sapiens
actaaaaaaggagaaattataataaattagccgtcttgcgcccctaggcc

SEQ ID NO: 2654 - DNA, 50 bp, Homo sapiens
acgacaaacctccttgtcaaagtgtgtaaaaataaaggattgctccatcc

SEQ ID NO: 2655 - DNA, 50 bp, Homo sapiens
ccactggggaagggaagtttcagtaacatgacactaaaatggcagagacg

SEQ ID NO: 2656 - DNA, 50 bp, Homo sapiens
aaagattggagctgaagacctaaagtgcttgctttttgcccgttgaccag

SEQ ID NO: 2657 - DNA, 50 bp, Homo sapiens
gaagtcagtgggaaacacacagaaatttattttaaaatctttcaggagct

SEQ ID NO: 2658 - DNA, 50 bp, Homo sapiens
agatgtattagaagtcctgactttcaagtgtaatttgctttggaggagga

SEQ ID NO: 2659 - DNA, 50 bp, Homo sapiens
ctgtgcagaagagctgccaggcagtgtcttagatgtgagacggaggccat

SEQ ID NO: 2660 - DNA, 50 bp, Homo sapiens
acatcatggagggtttagtgcttatctaatttgtgcctcactggacttgt

SEQ ID NO: 2661 - DNA, 50 bp, Homo sapiens
ttgcttaccaaaggaggcccaatttcactcaaatgttttgagaactgtgt

SEQ ID NO: 2662 - DNA, 50 bp, Homo sapiens
tcactcctctgtcctatgaagaccgctgccattggtgttgagaataataa

SEQ ID NO: 2663 - DNA, 50 bp, Homo sapiens
gttaagccaggacatccagaattcattgctttaataaagaacccaggccg

SEQ ID NO: 2664 - DNA, 50 bp, Homo sapiens
tcagttttaacaaatgctattaaagtggagaagcacactctggtcttgga

SEQ ID NO: 2665 - DNA, 50 bp, Homo sapiens
ctcactgcctctttgcagtaggggagagagcagagaagtacaggtcatct

SEQ ID NO: 2666 - DNA, 50 bp, Homo sapiens
ttgactttgctcgaggcaccttttttcctgtttctccttttctgttgtcg

SEQ ID NO: 2667 - DNA, 50 bp, Homo sapiens
aaatgggtttcactgtgaatgcgtgacaataagatattcccttgttccta

SEQ ID NO: 2668 - DNA, 50 bp, Homo sapiens
aacgaatttcctgaacctatcaaactggacaagaatgaccgggccaaggc

SEQ ID NO: 2669 - DNA, 50 bp, Homo sapiens
cttcccctggtcccctgtccctggggctgtttgttaaaaaagagtaataa

SEQ ID NO: 2670 - DNA, 50 bp, Homo sapiens
accgtgaaaattggtttcatttaacaaaagatcagatccctccttcagct

SEQ ID NO: 2671 - DNA, 50 bp, Homo sapiens
tttcttgttacacccactgcactctgcaaccagtgttgcctgcctcatgg

SEQ ID NO: 2672 - DNA, 50 bp, Homo sapiens
gggaaaaacaagaatttcatgactctacctgtggtctatctttaatttca

SEQ ID NO: 2673 - DNA, 50 bp, Homo sapiens
gctgtgcccttgaagagaatagtaatgatgggaatttagaggtttatgac

SEQ ID NO: 2674 - DNA, 50 bp, Homo sapiens
tccaaggaaatggtaacctgtttctgagaacacctgaaatcaatggctat

SEQ ID NO: 2675 - DNA, 50 bp, Homo sapiens
ttcattgtaatccactgttttggctttcatgaacaagtaaattacagtgt

SEQ ID NO: 2676 - DNA, 50 bp, Homo sapiens
acttatttccatgtttctgaatcttctttgtttcaaatggtgctgcatgt

SEQ ID NO: 2677 - DNA, 50 bp, Homo sapiens
atgcccggcctgggatgctgtttggagacggaataaatgttttctcattc

SEQ ID NO: 2678 - DNA, 50 bp, Homo sapiens
tactctaaacctgttatttctgtgctaataaacgagatgcagaacccttg

SEQ ID NO: 2679 - DNA, 50 bp, Homo sapiens
tgcagagagatactaagcagcaaaatcttggtgttgtgatgtacagaaat

SEQ ID NO: 2680 - DNA, 50 bp, Homo sapiens
agtctttgatcttgaaccgatacttttggatctcattgttgatatacctg

SEQ ID NO: 2681 - DNA, 50 bp, Homo sapiens
tggaatcaaataaaatgcttccactaccaaaagacattagagaaaacctt

SEQ ID NO: 2682 - DNA, 50 bp, Homo sapiens
tgccgaataccttaaagtaactaattatccttacacacaaaaggctcagt

SEQ ID NO: 2683 - DNA, 50 bp, Homo sapiens
ctttcccaggatcaaggccacagggaggaagattgcacgggcactgttct

SEQ ID NO: 2684 - DNA, 50 bp, Homo sapiens
cttgtaaactagcgccaaggaactgcagcaaataaactccaactctgccc

SEQ ID NO: 2685 - DNA, 50 bp, Homo sapiens; identical to SEQ ID NO: 1846

SEQ ID NO: 2686 - DNA, 50 bp, Homo sapiens
aggagggtttaaatagggttcagagatcataggaatattaggagttacct

SEQ ID NO: 2687 - DNA, 50 bp, Homo sapiens
tggtggaagtaaaaactggtaactcactcaagtgaatgaatggtcttgca

SEQ ID NO: 2688 - DNA, 50 bp, Homo sapiens
gcaggaaagggaaacagacgcgacagcaacaagagcaccagaagtatatg

SEQ ID NO: 2689 - DNA, 50 bp, Homo sapiens
tccattctgtttcggattttaagtttgagagacttgctaatgaatctcct

SEQ ID NO: 2690 - DNA, 50 bp, Homo sapiens
ccttcagaaacaccgtaattctaaataaacctcttcccatacacctttcc

SEQ ID NO: 2691 - DNA, 50 bp, Homo sapiens
ctggacaactttgagtactgacatcattgataaataaactggcttgtggt

SEQ ID NO: 2692 - DNA, 50 bp, Homo sapiens
cccaggggattttttaagtagatggggggacacggtgaactggctgtgtc

SEQ ID NO: 2693 - DNA, 50 bp, Homo sapiens
actccaaaataaatcaaggctgcaatgcagctggtgctgttcagattcca

SEQ ID NO: 2694 - DNA, 50 bp, Homo sapiens
tgaaatcttaagtgtcttatatgtaatcctgtaggttggtacttccccca

SEQ ID NO: 2695 - DNA, 50 bp, Homo sapiens
tgggagtcttctcttttagacaggggctttttgtttttaaccccaattgt

SEQ ID NO: 2696 - DNA, 50 bp, Homo sapiens
tgacccagatatggaaacagaagacaaaattgtaagccagagtcaacaaa

SEQ ID NO: 2697 - DNA, 50 bp, Homo sapiens
aggtttcatcaggtggttaaagtcgtcaaagttgtaagtgactaaccaag

SEQ ID NO: 2698 - DNA, 50 bp, Homo sapiens
atgctgtcaaagttacagtttacgcaggacattcttgccgtattctcatg

SEQ ID NO: 2699 - DNA, 50 bp, Homo sapiens
tgtgtgtttactaacccttccctgaggcttgtgtatgttggatattgtgg

SEQ ID NO: 2700 - DNA, 50 bp, Homo sapiens
tctgtaatcaaatgattggtgtcattttcccatttgccaatgtagtctca

SEQ ID NO: 2701 - DNA, 50 bp, Homo sapiens
tgcccagcagccatcttaatacattaaaccagtttaaaaaataccttcca

SEQ ID NO: 2702 - DNA, 50 bp, Homo sapiens
gccagagttgccaacccccggctggataccttcagcagagaaatcttccg

SEQ ID NO: 2703 - DNA, 50 bp, Homo sapiens
aatccattaacacctgctcacatcttactcaaaattgtagagttcatagt

SEQ ID NO: 2704 - DNA, 50 bp, Homo sapiens
atttgcaatttggaatttgtgtgagttgatttagtaaaatgttaaaccgc

SEQ ID NO: 2705 - DNA, 50 bp, Homo sapiens
aagtaaagcctcaggaatgcccacgcctttcttccaaagcctttgtctct

SEQ ID NO: 2706 - DNA, 50 bp, Homo sapiens
tcaaacaaatgactttcatattgcaacaatctttgtaagaaccactcaaa

SEQ ID NO: 2707 - DNA, 50 bp, Homo sapiens
ggggaatgtgttccttcattgtatttgggccttttgtattgcactcttga

SEQ ID NO: 2708 - DNA, 50 bp, Homo sapiens
ttgtttacctttcgtgcggtggattctttttaactccgtctacctggcgt

SEQ ID NO: 2709 - DNA, 50 bp, Homo sapiens
ggggtttgtgctatacactgggatgtctaattgcagcaataaagcctttc

SEQ ID NO: 2710 - DNA, 50 bp, Homo sapiens; identical to SEQ ID NO: 1614

SEQ ID NO: 2711 - DNA, 50 bp, Homo sapiens
agcctgcttctgccacacctcgctctcagtctctccacatttccatagag

SEQ ID NO: 2712 - DNA, 50 bp, Homo sapiens
aagtttctcagctcccatttctactctcccatggcttcatgcttctttca

SEQ ID NO: 2713 - DNA, 50 bp, Homo sapiens
gagctactgtgctcatctaaagtgtttgccccacttcccaccccgtctcc

SEQ ID NO: 2714 - DNA, 50 bp, Homo sapiens
atgttaagatttgtgtacaaattgaaatgtctgtactgatcctcaaccaa

SEQ ID NO: 2715 - DNA, 50 bp, Homo sapiens
tctgttgatagctggagaactttagtttcaagtactacattgtgaaagca

SEQ ID NO: 2716 - DNA, 50 bp, Homo sapiens
tgaggggtttcagaattttgcattgcagtcatagaagagatttatttcct

SEQ ID NO: 2717 - DNA, 50 bp, Homo sapiens
ccttgggagggagacttcatgtggtttattgcgagttttttgtttacttt

SEQ ID NO: 2718 - DNA, 50 bp, Homo sapiens
gtatgttaatgccagtcaccagcaggctatttcaaggtcagaagtaatga

SEQ ID NO: 2719 - DNA, 50 bp, Homo sapiens
gcccctaaaggcaagaagaaaaagtaaaagaccttggctcatagaaagtc

SEQ ID NO: 2720 - DNA, 50 bp, Homo sapiens
agtgaaatatgttacagaacatgcacttgccctaataaaaaatcagtgaa

SEQ ID NO: 2721 - DNA, 50 bp, Homo sapiens
tgcagatgctcttaaaagcattgataacctttgtgacgaacataaagaga

SEQ ID NO: 2722 - DNA, 50 bp, Homo sapiens
gctagttcatgtgttctccattcttgtgagcatcctaataaatctgttcc

SEQ ID NO: 2723 - DNA, 50 bp, Homo sapiens
aaccctcccaatatccctagcagcagcagcaaaccaaagtcaaagtatcc

SEQ ID NO: 2724 - DNA, 50 bp, Homo sapiens
cacctccccctacccatatccctcccgtgtgtggttggaaaacttttgtt

SEQ ID NO: 2725 - DNA, 50 bp, Homo sapiens
gagtcctgagccactgccaacatttcccttcttccagttgcactattctg

SEQ ID NO: 2726 - DNA, 50 bp, Homo sapiens
ccccaccccagaacagaaccgtgtctctgataaaggttttgaagtgaata

SEQ ID NO: 2727 - DNA, 50 bp, Homo sapiens
cccatttcttgtttttaaaagaccaacaaatctcaagccctataaatggc

SEQ ID NO: 2728 - DNA, 50 bp, Homo sapiens
agtgtagcttctgaaaggtgctttctccatttatttaaaactacccatgc

SEQ ID NO: 2729 - DNA, 50 bp, Homo sapiens
gagtgcccgattcctcttagagaaaatccatagccttcagatcttggtgt

SEQ ID NO: 2730 - DNA, 50 bp, Homo sapiens
actttgacacctactgtgttataaaatatatcatcagatgtgccttgaga

SEQ ID NO: 2731 - DNA, 50 bp, Homo sapiens; identical to SEQ ID NO: 1697

SEQ ID NO: 2732 - DNA, 50 bp, Homo sapiens
tgatattcaactctgagcatcaggttctaaaaaataatacatactggggt

SEQ ID NO: 2733 - DNA, 50 bp, Homo sapiens
gtcatctccccatttggtcccctggactgtctttgttgattctaacttgt

SEQ ID NO: 2734 - DNA, 50 bp, Homo sapiens
gagaataatgatgtaccaataagtggagattcctccttatgatgtatgct

SEQ ID NO: 2735 - DNA, 50 bp, Homo sapiens
acaagacagactccactcaaaatttatatgaacaccactagatacttcct

SEQ ID NO: 2736 - DNA, 50 bp, Homo sapiens
tccataccattgtgtgtggaggatttacagctaagctgtagttgcagagt

SEQ ID NO: 2737 - DNA, 50 bp, Homo sapiens
acacttttgattgttttctagatgtctaccaataaatgcaatttgtgacc

SEQ ID NO: 2738 - DNA, 50 bp, Homo sapiens
actgtacaatttctgaagatggttattaacactgtgctgttaagcatcca

SEQ ID NO: 2739 - DNA, 50 bp, Homo sapiens
tcagtcctttcttagggaaatgacagggcaaagcaatttttctgttggct

SEQ ID NO: 2740 - DNA, 50 bp, Homo sapiens
agtacaaggcccgaagggtagtgatggtgctaaactcaacatggatttgg

SEQ ID NO: 2741 - DNA, 50 bp, Homo sapiens
ccccagtctgcaaaagaagcacaattctattgctttgtcttgcttatagt

SEQ ID NO: 2742 - DNA, 50 bp, Homo sapiens; identical to SEQ ID NO: 256

SEQ ID NO: 2743 - DNA, 50 bp, Homo sapiens; identical to SEQ ID NO: 1718

SEQ ID NO: 2744 - DNA, 50 bp, Homo sapiens
ccttctttcacaggcatcaggaattgtcaaatgatgattatgagttccct

SEQ ID NO: 2745 - DNA, 50 bp, Homo sapiens
catcttcagcatcgtcttcttgcacatgaaggagaaggagaagtccgact

SEQ ID NO: 2746 - DNA, 50 bp, Homo sapiens
gggaatgctgcaaatgccaaacagctttatgatttcattcacacctcttt

SEQ ID NO: 2747 - DNA, 50 bp, Homo sapiens
ttaaaaatggttgtttaagactttaacaatgggaaccccttgtgagcatg

SEQ ID NO: 2748 - DNA, 50 bp, Homo sapiens
gggagaagtttgcagagcacttcccacctctctgaatagtgtgtatgtgt

SEQ ID NO: 2749 - DNA, 50 bp, Homo sapiens
tggttgacccttgtatgtcacagctctgctctatttattattattttgca

SEQ ID NO: 2750 - DNA, 50 bp, Homo sapiens
tgggaaggaaggctctgtcttcaactctttgaccctccatgtgtaccata

SEQ ID NO: 2751 - DNA, 50 bp, Homo sapiens; identical to SEQ ID NO: 1777

SEQ ID NO: 2752 - DNA, 50 bp, Homo sapiens
ctccccgtgctaaggcccacaaaagccaggactctctgtgcgtgaccctc

SEQ ID NO: 2753 - DNA, 50 bp, Homo sapiens
aattcaagaagaaaaacccaagaagaagaagaaggcacaggaggatctct

SEQ ID NO: 2754 - DNA, 50 bp, Homo sapiens
tcccagagctgatgctattgtacttgcacattggagactgaaaggaaaga

SEQ ID NO: 2755 - DNA, 50 bp, Homo sapiens
ggggaagccgaaggttacaaaggcaaagaaggcagctccgaagaaaaagt

SEQ ID NO: 2756 - DNA, 50 bp, Homo sapiens
tccctgaagaaatatctgtgaaccttctttctgttcagtcctaaaattcg

SEQ ID NO: 2757 - DNA, 50 bp, Homo sapiens
cctctccgaccttcatcactattcttaggataatgctggcgggcagagat

SEQ ID NO: 2758 - DNA, 50 bp, Homo sapiens
actgccatcttacgactatttcttctttttaatacacttaactcaggcca

SEQ ID NO: 2759 - DNA, 50 bp, Homo sapiens
agggtgtttcgttccctttaaatgaatcaacactgccaccttctgtacga

SEQ ID NO: 2760 - DNA, 50 bp, Homo sapiens; identical to SEQ ID NO: 130

SEQ ID NO: 2761 - DNA, 50 bp, Homo sapiens
catttcctgagaccaccagagagaggggagaagcctgggattgacagaag

SEQ ID NO: 2762 - DNA, 50 bp, Homo sapiens; identical to SEQ ID NO: 2761

SEQ ID NO: 2763 - DNA, 50 bp, Homo sapiens
gctaagaagcctataagaggaatttcttttccttcattcatagggaaagg

SEQ ID NO: 2764 - DNA, 50 bp, Homo sapiens
actgacagagtgaactacagaaatagcttttcttcctaaaggggattgtt

SEQ ID NO: 2765 - DNA, 50 bp, Homo sapiens
cagacaatggatgtggggtagaagaagaaaactttgaaggcttaatctct

SEQ ID NO: 2766 - DNA, 50 bp, Homo sapiens
aaaagaagaggaaaagtttagccaagagaatcagagaaagatgctgcatt

SEQ ID NO: 2767 - DNA, 50 bp, Homo sapiens
agtgcacatatttcataaccaaattagcagcaccggtcttaatttgatgt

SEQ ID NO: 2768 - DNA, 50 bp, Homo sapiens
tagacctctttttcttaccagtctcctcccctactctgccccctaagctg

SEQ ID NO: 2769 - DNA, 50 bp, Homo sapiens
agcacagtaaaagtaaagactattctgtttctaggctgttgaatcaaagt

SEQ ID NO: 2770 - DNA, 50 bp, Homo sapiens
catgggcacagtggtgacccccttgattcccaccgtacaaccccctccac

SEQ ID NO: 2771 - DNA, 50 bp, Homo sapiens
cgttatccagtgtgaaaatcagtgagtcctccctggcatcctcgtgaaag

SEQ ID NO: 2772 - DNA, 50 bp, Homo sapiens
gctgaagagtatagtaaagacacctcaaaaggcatgggagggtattatgc

SEQ ID NO: 2773 - DNA, 50 bp, Homo sapiens
ttcagactggtttctgttttttggttattaaaatggtttcctattttgct

SEQ ID NO: 2774 - DNA, 50 bp, Homo sapiens
tttatgattaggtgacgagttgacattgagattgtccttttcccctgatc

SEQ ID NO: 2775 - DNA, 50 bp, Homo sapiens
ccccaaccaggtccgtatgcggtaccttttaaaggttcagtttaatttcc

SEQ ID NO: 2776 - DNA, 50 bp, Homo sapiens
tcctgcaaggctggactgtgatcttcaatcatcctgcccatctctggtac

SEQ ID NO: 2777 - DNA, 50 bp, Homo sapiens
ggtcacggctactcatggaagcaggaccagtaagggaccttcgattaaaa

SEQ ID NO: 2778 - DNA, 50 bp, Homo sapiens
ccttctaacctgaactgatgggtttctccagagggaattgcagagtactg

SEQ ID NO: 2779 - DNA, 50 bp, Homo sapiens
atgtgtaggaggaagagttcaggtggaaaaggagggagctactctcaggc

SEQ ID NO: 2780 - DNA, 50 bp, Homo sapiens
aacgattgtctgcccatgtcctgcctgaaataccatgattgtttatggaa

SEQ ID NO: 2781 - DNA, 50 bp, Homo sapiens
ttccttttaggtatattgcgctaagtgaaacttgtcaaataaatcctcct

SEQ ID NO: 2782 - DNA, 50 bp, Homo sapiens
gtcttgactttggcaaatgagccggagccccttgggcaggtcacacaacc

SEQ ID NO: 2783 - DNA, 50 bp, Homo sapiens
gatacagagttgtccttggaggatggagacaggtgcaaggccaagatgtg

SEQ ID NO: 2784 - DNA, 50 bp, Homo sapiens
tcccatgatggaagtctgcgtaaccaataaattgtgcctttctcactcaa

SEQ ID NO: 2785 - DNA, 50 bp, Homo sapiens
tctacatgtcttgggggcgggctcaaattcttcgaaagtggttggattaa

SEQ ID NO: 2786 - DNA, 50 bp, Homo sapiens
acctgttatcctttgtagagcacacagagttaaaagttgaatatagcaat

SEQ ID NO: 2787 - DNA, 50 bp, Homo sapiens
tgagcttctccagcagtgcgggtcctgggctcctgaaggcttattccatc

SEQ ID NO: 2788 - DNA, 50 bp, Homo sapiens
gcatgtcctcatcctttcctgccataaaagctatgacacgagaatcagaa

SEQ ID NO: 2789 - DNA, 50 bp, Homo sapiens
acccctccccatgaacacaagggttttatcctttcctttaaaaacagtgt

SEQ ID NO: 2790 - DNA, 50 bp, Homo sapiens
tgcaaccaactatccaagtgttataccaactaaaacccccaataaacctt

SEQ ID NO: 2791 - DNA, 50 bp, Homo sapiens
atgcccagacaaaaagctaataccagtcactcgataataaagtattcgca

SEQ ID NO: 2792 - DNA, 50 bp, Homo sapiens
tggcactgagaaacatgcaagatacaggaaaaatgaaaatgttacaagct

SEQ ID NO: 2793 - DNA, 50 bp, Homo sapiens
tctcaaaggagtaactgcagcttggtttgaaatttgtactgtttctatca

SEQ ID NO: 2794 - DNA, 50 bp, Homo sapiens
gtcaacctttgtgagaagccgtatccacttcacaggataaaattgtccat

SEQ ID NO: 2795 - DNA, 50 bp, Homo sapiens
atctccacagcccacccatcccctgagcacactaaccacctcatgcaggc

SEQ ID NO: 2796 - DNA, 50 bp, Homo sapiens
tttcctgactcctccttgcaaacaaaatgatagttgacactttatcctga

SEQ ID NO: 2797 - DNA, 50 bp, Homo sapiens
cctgcagtaacccataggaaataaactgtagagttccatattctgcggcc

SEQ ID NO: 2798 - DNA, 50 bp, Homo sapiens
tagaaagggtttttatggaccaatgccccagttgtcagtcagagccgttg

SEQ ID NO: 2799 - DNA, 50 bp, Homo sapiens
tgtgatgacgtgagatcaataagaagaacctagtctagagacaatgatgc

SEQ ID NO: 2800 - DNA, 50 bp, Homo sapiens
gtgcttgctgtctctcccggacacccttaaagactgtctttttagcaaaa

SEQ ID NO: 2801 - DNA, 50 bp, Homo sapiens
aacattgtttttgtatattgggtgtagatttctgacatcaaaacttggac

SEQ ID NO: 2802 - DNA, 50 bp, Homo sapiens
tgtgtaactggattccttgcatggatcttgtatatagttttatttgctga

SEQ ID NO: 2803 - DNA, 50 bp, Homo sapiens
caggacctccaagccactgagcaatgtataaccccaaagggaattcaaaa

SEQ ID NO: 2804 - DNA, 50 bp, Homo sapiens
gatctgacccaccagtttgtacatcacgtcctgcatgtcccacaccattt

SEQ ID NO: 2805 - DNA, 50 bp, Homo sapiens; identical to SEQ ID NO: 1639

SEQ ID NO: 2806 - DNA, 50 bp, Homo sapiens
tgcgtcttgtgaaattgtgtagagtgtttgtgagctttttgttccctcat

SEQ ID NO: 2807 - DNA, 50 bp, Homo sapiens
cttcggcctccctggccctgggttaaaataaaagctttctggtgatcctg

SEQ ID NO: 2808 - DNA, 50 bp, Homo sapiens
tgagcttgtgcttagtatttacattggatgccagttttgtaatcactgac

SEQ ID NO: 2809 - DNA, 50 bp, Homo sapiens
atttgaaattttctgcagcattaaagctggcgcttaataagaataagtaa

SEQ ID NO: 2810 - DNA, 50 bp, Homo sapiens
tcgcattctgtttcttgctttaaaagaagagtaaagacaagagtgttgga

SEQ ID NO: 2811 - DNA, 50 bp, Homo sapiens; identical to SEQ ID NO: 618

SEQ ID NO: 2812 - DNA, 50 bp, Homo sapiens
ctgtcagccaaggtgcctgaaacgatacgtgtgcccactccactgtcaca

SEQ ID NO: 2813 - DNA, 50 bp, Homo sapiens; identical to SEQ ID NO: 1278

SEQ ID NO: 2814 - DNA, 50 bp, Homo sapiens
tcgatcagtgctcagagattgtgaaatgcagtgttagctccctgggattc

SEQ ID NO: 2815 - DNA, 50 bp, Homo sapiens
aggacaaatcttgttgtattaacagcagggtcacttctcattttctttgc

SEQ ID NO: 2816 - DNA, 50 bp, Homo sapiens
agtcgtattctgtcacataatattttgaagaaaacttggctgtcgaaaca

SEQ ID NO: 2817 - DNA, 50 bp, Homo sapiens
aggagggtgggtggaacaggtggactggagtttctcttgagggcaataaa

SEQ ID NO: 2818 - DNA, 50 bp, Homo sapiens; identical to SEQ ID NO: 2817

SEQ ID NO: 2819 - DNA, 50 bp, Homo sapiens
tgcacctcaagattttaaggagataatgtttttagagagaatttctgctt

SEQ ID NO: 2820 - DNA, 50 bp, Homo sapiens
gcttatggtccccagcatttacagtaacttgtgaatgttaagtatcatct

SEQ ID NO: 2821 - DNA, 50 bp, Homo sapiens
cttgttttgtttgtctctccttttcttttgttactgttcttgctgctaga

SEQ ID NO: 2822 - DNA, 50 bp, Homo sapiens; identical to SEQ ID NO: 704

SEQ ID NO: 2823 - DNA, 50 bp, Homo sapiens
tcaagaataaaaatgcctctccagccttaagtatttacatgctcccaggt

SEQ ID NO: 2824 - DNA, 50 bp, Homo sapiens
tctggaaatgtgttataagctaggagaatccctttggacagtctttattt

SEQ ID NO: 2825 - DNA, 50 bp, Homo sapiens
atttcctatcaccatacttttccatgtgaaaacctgagcctatttctagt

SEQ ID NO: 2826 - DNA, 50 bp, Homo sapiens
tggctgttgctttgcttcatgtgtatggctatttgtatttaacaagactt

SEQ ID NO: 2827 - DNA, 50 bp, Homo sapiens
atagccatcctctttgcagtcctgttggttgtgctcatcctcttcctagt

SEQ ID NO: 2828 - DNA, 50 bp, Homo sapiens
agggccagggctggtgtccctaaggttgtacagactcttgtgaatatttg

SEQ ID NO: 2829 - DNA, 50 bp, Homo sapiens
gccgtgacaatttgttctttgatgtgattgtatttccaatttcttgttca

SEQ ID NO: 2830 - DNA, 50 bp, Homo sapiens
tggtatatacaactttcagagcctcttgtatttggaaggctggaagggcc

SEQ ID NO: 2831 - DNA, 50 bp, Homo sapiens
gctactgcagggtgaggaagaaggggaagaagattgatcaaacagaatga

SEQ ID NO: 2832 - DNA, 50 bp, Homo sapiens
tgtttcaagcccttctgtaaaatatgaagaaaagtctcttagcattctgt

SEQ ID NO: 2833 - DNA, 50 bp, Homo sapiens; identical to SEQ ID NO: 490

SEQ ID NO: 2834 - DNA, 50 bp, Homo sapiens
atctttgtgagcaattatgctcccaaatctaagcaagtaataaagaaggg

SEQ ID NO: 2835 - DNA, 50 bp, Homo sapiens
tgtaaagtttgtacaatttgtcctgaagctttgtgtttggctgcacctgc

SEQ ID NO: 2836 - DNA, 50 bp, Homo sapiens
acagtataactcctgaatgctacttaaataaaccaggattcaaactgcaa

SEQ ID NO: 2837 - DNA, 50 bp, Homo sapiens
agaagcagattttcctgtagaaaaactaatttttctgccttttaccaaaa

SEQ ID NO: 2838 - DNA, 50 bp, Homo sapiens
gagcttgctccagattctgatgcatacggctatattggtttatgtagtca

SEQ ID NO: 2839 - DNA, 50 bp, Homo sapiens
atgggtgttatcacctagctgaatgtttttctaaaggagtttatgttcca

SEQ ID NO: 2840 - DNA, 50 bp, Homo sapiens
acgtgcttcttggtacaggtttgtgaatgacagtttatcgtcatgctgtt

SEQ ID NO: 2841 - DNA, 50 bp, Homo sapiens
tgttgttgttggcaagctgcaggtttgtaatgcaaaaggctgattactga

SEQ ID NO: 2842 - DNA, 50 bp, Homo sapiens
tcattgttcgcttctgtaattctgaaaaactttaaactggtagaacttgg

SEQ ID NO: 2843 - DNA, 50 bp, Homo sapiens
ccagtgctgtttggtggtctgccttctttttaatggtattttcttcctca

SEQ ID NO: 2844 - DNA, 50 bp, Homo sapiens
gccccaccattcatcctgtctgaaggtcctgggtttggtgtgaccgcttg

SEQ ID NO: 2845 - DNA, 50 bp, Homo sapiens
ccgacaggtgggcctgggaggaaaatgtttacatttttaaaggcacactg

SEQ ID NO: 2846 - DNA, 50 bp, Homo sapiens
ggggtggacgcctctgccttcacttgaacacaaatgtgcttcctataaaa

SEQ ID NO: 2847 - DNA, 50 bp, Homo sapiens
ggcagcccccagtccctttctgtcccagctcagttttccaaaagacactg

SEQ ID NO: 2848 - DNA, 50 bp, Homo sapiens
ctgttaagcactgttatgctcagtcatacacgcgaaaggtacaatgtctt

SEQ ID NO: 2849 - DNA, 50 bp, Homo sapiens; identical to SEQ ID NO: 198

SEQ ID NO: 2850 - DNA, 50 bp, Homo sapiens
ttcagttttgctttcaattttatgtaccttagttctgagttagacctgca

SEQ ID NO: 2851 - DNA, 50 bp, Homo sapiens
aaggattatgaggaggttggtgtgcattctgttgaaggagagggtgagga

SEQ ID NO: 2852 - DNA, 50 bp, Homo sapiens
tcccttccttctgttgctggtgtactctaggacttcaaagtgtgtctggg

SEQ ID NO: 2853 - DNA, 50 bp, Homo sapiens
agttcattaaaaactgcaaaaccaatctgtatcatgtaccaaactgactt

SEQ ID NO: 2854 - DNA, 50 bp, Homo sapiens
tgcacgttcctcctggttccttcgcttgtgtttctgtacttaccaaaaat

SEQ ID NO: 2855 - DNA, 50 bp, Homo sapiens
tgccagacctccttcctgacctctgaggcaggagaggaataaagacggtc

SEQ ID NO: 2856 - DNA, 50 bp, Homo sapiens
agtcccaagggtgttttgttactgttttctccatgaataaactcacttga

SEQ ID NO: 2857 - DNA, 50 bp, Homo sapiens
attaatgtcatttctggaagtgtgaaaatgttaatgttcaacaagcaaca

SEQ ID NO: 2858 - DNA, 50 bp, Homo sapiens
gcgggtgggccgagcagtgtggacatcagccactttttatattcatgtac

SEQ ID NO: 2859 - DNA, 50 bp, Homo sapiens
ccactgagaactaaatgctgtaccacagagccgggtgtgaactatggttt

SEQ ID NO: 2860 - DNA, 50 bp, Homo sapiens
aaacaatcgctccgggctcagggctgcgcggctcttcccttcattccatg

SEQ ID NO: 2861 - DNA, 50 bp, Homo sapiens
tgtcctctgttcaattcctaacgcaaactacaataaatggtgacacacgt

SEQ ID NO: 2862 - DNA, 50 bp, Homo sapiens
agcacctaaggagcttgaatcttggttcctgtaaaatttcaaattgatgt

SEQ ID NO: 2863 - DNA, 50 bp, Homo sapiens
accaacactgtcccaaggtgaaatgaagcaacagagaggaaattgtacat

SEQ ID NO: 2864 - DNA, 50 bp, Homo sapiens
tgtcagccatttcaatgtcttgggaaacaattttttgtttttgttctgtt

SEQ ID NO: 2865 - DNA, 50 bp, Homo sapiens
agagcttgatcgccagtggaagaagattagtgcaatcattgagaagagga

SEQ ID NO: 2866 - DNA, 50 bp, Homo sapiens
tttccctcttccctgacctcccaactctaaagccaagcactttatatttt

SEQ ID NO: 2867 - DNA, 50 bp, Homo sapiens
ggcaggtgaccattggcacacgctagaagtttatggcagagctttacaaa

SEQ ID NO: 2868 - DNA, 50 bp, Homo sapiens
ctgtttgtagataggttttttatctctcagtacacattgccaaatggagt

SEQ ID NO: 2869 - DNA, 50 bp, Homo sapiens; identical to SEQ ID NO: 84

SEQ ID NO: 2870 - DNA, 50 bp, Homo sapiens
tagactcattgtaagttgccactgccaacatgagaccaaagtgtgtgact

SEQ ID NO: 2871 - DNA, 50 bp, Homo sapiens
caaacctttctggcctgttatgattctgaacatttgacttgaaccacaag

SEQ ID NO: 2872 - DNA, 50 bp, Homo sapiens
gggaaagtatagcatgaaaccagaggttctcagaatgaccgtaagatagc

SEQ ID NO: 2873 - DNA, 50 bp, Homo sapiens; identical to SEQ ID NO: 1594

SEQ ID NO: 2874 - DNA, 50 bp, Homo sapiens; identical to SEQ ID NO: 1643

SEQ ID NO: 2875 - DNA, 50 bp, Homo sapiens
cttctggcacccctggggttcaatactggaagtgccttatttaaccagac

SEQ ID NO: 2876 - DNA, 50 bp, Homo sapiens
ggtctttagcctccaccttgtctaagctttggtctataaagtgcgctaca

SEQ ID NO: 2877 - DNA, 50 bp, Homo sapiens
tgatgatatgacatctggctaaaaagaaattattgcaaaactaaccacga

SEQ ID NO: 2878 - DNA, 50 bp, Homo sapiens
tccaaagcagtctccactgttgttgtgactacagctccgtctcctaaaca

SEQ ID NO: 2879 - DNA, 50 bp, Homo sapiens
attgtcaccaggttggaactcttgcctctgtgaggatgccttctctactg

SEQ ID NO: 2880 - DNA, 50 bp, Homo sapiens
ttttctttgtatatttctagtatggcacatgatatgagtcactgcctttt

SEQ ID NO: 2881 - DNA, 50 bp, Homo sapiens
tgaccttcatgataccagtgagaagccaggctagagaaataaaatcctga

SEQ ID NO: 2882 - DNA, 50 bp, Homo sapiens
acggattggttaaaaaatgcttcatatttgaaaaagctgggaattgctgt

SEQ ID NO: 2883 - DNA, 50 bp, Homo sapiens
gtctctctccattgtgttccgatccatttctgtgtgttcccccaaccttt

SEQ ID NO: 2884 - DNA, 50 bp, Homo sapiens
gccactgccataacttgtttgtaaaagagctgttctttttgactgattgt

SEQ ID NO: 2885 - DNA, 50 bp, Homo sapiens
gaacattgcccagcactacggcatgtcgtacctcctggagaccctggagt

SEQ ID NO: 2886 - DNA, 50 bp, Homo sapiens
atcttcattgggggattgagcagcatttaataaagtctatgtttgtattt

SEQ ID NO: 2887 - DNA, 50 bp, Homo sapiens
ttataaccgagggctggcgttttggaatcgaatttcgacagggattggaa

SEQ ID NO: 2888 - DNA, 50 bp, Homo sapiens; identical to SEQ ID NO: 1820

SEQ ID NO: 2889 - DNA, 50 bp, Homo sapiens; identical to SEQ ID NO: 206

SEQ ID NO: 2890 - DNA, 50 bp, Homo sapiens
aaccaaggagttttccccgtttgtaaaaagacattgtagataattgaatg

SEQ ID NO: 2891 - DNA, 50 bp, Homo sapiens
accatgttctttcgttaaagatttgctttatacaagattgttgcagtacc

SEQ ID NO: 2892 - DNA, 50 bp, Homo sapiens
cacatctgcttccactgtgttcccacgggtgccatgaagtgtgtgaggag

SEQ ID NO: 2893 - DNA, 50 bp, Homo sapiens
cgcactacttcacctgagccacccaacctaaatgtacttatctgtcccca

SEQ ID NO: 2894 - DNA, 50 bp, Homo sapiens; identical to SEQ ID NO: 2193

SEQ ID NO: 2895 - DNA, 50 bp, Homo sapiens
ctctccaagagtattattaacgctgctgtacctcgatctgaatctgccgg

SEQ ID NO: 2896 - DNA, 50 bp, Homo sapiens
tccctaatagaaagccacctattctttgttggatttcttcaagtttttct

SEQ ID NO: 2897 - DNA, 50 bp, Homo sapiens
agtactgcttttgtatgtatgttgaacaggatccaggtttttatagcttg

SEQ ID NO: 2898 - DNA, 50 bp, Homo sapiens
cactttctatcctctgtaaactttttgtgctgaatgttgggactgctaaa

SEQ ID NO: 2899 - DNA, 50 bp, Homo sapiens
gaagaatgggcaaagaagtaatcatgtagttgaagtctgtggatgcagct

SEQ ID NO: 2900 - DNA, 50 bp, Homo sapiens
caaaggttcttgagactcttgatatttctgtcttctccttgtgctttcct

SEQ ID NO: 2901 - DNA, 50 bp, Homo sapiens
ccgatggatctacagttgcaatgagaagcagaagttacttcctcaccagc

SEQ ID NO: 2902 - DNA, 50 bp, Homo sapiens
ttcctgcataactcaatctgaaccaaggattgtagtttagttttcctcct

SEQ ID NO: 2903 - DNA, 50 bp, Homo sapiens
gcagggtggtggtattctgtcatttacacacgtcgttctaattaaaaagc

SEQ ID NO: 2904 - DNA, 50 bp, Homo sapiens
gcactttttgtttgaatgttagatgcttagtgtgaagttgatacgcaagc

SEQ ID NO: 2905 - DNA, 50 bp, Homo sapiens
gcaagaaatattccattgaaatattgtgctgtaacatgggaaagtgtaaa

SEQ ID NO: 2906 - DNA, 50 bp, Homo sapiens
gccaacactgtctgtctcaaatactgtgctgtgagttgtttcaataaagg

SEQ ID NO: 2907 - DNA, 50 bp, Homo sapiens
gacctcatctccaagatggagaagatctgacctccacggagccgctgtcc

SEQ ID NO: 2908 - DNA, 50 bp, Homo sapiens
ctttactaaaaaagaagcacctgagtggtctaagaaacaaaagatgaaga

SEQ ID NO: 2909 - DNA, 50 bp, Homo sapiens
gcctggaagactctgaaggagcgtgagagcatcctgaagctgctggatgg

SEQ ID NO: 2910 - DNA, 50 bp, Homo sapiens
caggaggaagctctggcccttgtattacacattctggacattaaaaataa

SEQ ID NO: 2911 - DNA, 50 bp, Homo sapiens
gccttttgagtctttccgatacctgagtttttatgcttataatttttgtt

SEQ ID NO: 2912 - DNA, 50 bp, Homo sapiens
ttaagctgaggatacaaccaggaaatgcaacggtgtcagattgtgttcaa

SEQ ID NO: 2913 - DNA, 50 bp, Homo sapiens; identical to SEQ ID NO: 1714

SEQ ID NO: 2914 - DNA, 50 bp, Homo sapiens
agcaataaactctggatgtttgtgcgcgtgtgtggacagtcttatcttcc

SEQ ID NO: 2915 - DNA, 50 bp, Homo sapiens
agctgttgatgctggttggacaggtttgagtcaaattgtactttgctcca

SEQ ID NO: 2916 - DNA, 50 bp, Homo sapiens
aggtgacatttcccaccctgtgcccgtgttcccaataaaaacaaattcac

SEQ ID NO: 2917 - DNA, 50 bp, Homo sapiens
ctgtggctgactgtaatactgtacaactgtttctgaccattaaatgctgt

SEQ ID NO: 2918 - DNA, 50 bp, Homo sapiens
acatatgcagacctgacactcaagagtggctagctacacagagtccatct

SEQ ID NO: 2919 - DNA, 50 bp, Homo sapiens
tgacttcacagacatggtctagaatctgtacccttacccacatatgaaga

SEQ ID NO: 2920 - DNA, 50 bp, Homo sapiens
cccagtctctgtcagcactcccttcttcccttttatagttcatcagccac

SEQ ID NO: 2921 - DNA, 50 bp, Homo sapiens
tgactgagtacccctttagtgagtacccctttagtgctatatttgtgcca

SEQ ID NO: 2922 - DNA, 50 bp, Homo sapiens
tgccttttgagcaaatagggaatctaagggaggaaattatcaactgtgca

SEQ ID NO: 2923 - DNA, 50 bp, Homo sapiens
gcggggccggggggactctggtatctaattctttaatgattcctataaat

SEQ ID NO: 2924 - DNA, 50 bp, Homo sapiens
acaactttctgtacaatattgattcccatctggcatattctaatcaggtt

SEQ ID NO: 2925 - DNA, 50 bp, Homo sapiens; identical to SEQ ID NO: 633

SEQ ID NO: 2926 - DNA, 50 bp, Homo sapiens
aacaacattaacttgtggcctctttctacacctggaaatttactcttgaa

SEQ ID NO: 2927 - DNA, 50 bp, Homo sapiens
acagccgagtcctgcatcagccctttatcctcacacgcttttctacaatg

SEQ ID NO: 2928 - DNA, 50 bp, Homo sapiens
gtcaaggctaagtcaaatgaaactgaattttaaactttttgcatgcttct

SEQ ID NO: 2929 - DNA, 50 bp, Homo sapiens
aaacgacatgaaggtagatgaagtcctttacgaagactcgtcaacagctt

SEQ ID NO: 2930 - DNA, 50 bp, Homo sapiens
cccaataccaagaccaactggcatagagccaactgagataaatgctattt

SEQ ID NO: 2931 - DNA, 50 bp, Homo sapiens
gggtctatacagagtcaatatattttttcagagaaagttagttcggctcg

SEQ ID NO: 2932 - DNA, 50 bp, Homo sapiens
ccagaaagtgtgggctgaagatggttggtttcatgtgggggtattatgta

SEQ ID NO: 2933 - DNA, 50 bp, Homo sapiens
tccaaccttgagatccagtgtcaggagttctctattcctcccaactctga

SEQ ID NO: 2934 - DNA, 50 bp, Homo sapiens
tggcacagaaaagggaccaagtttaaaaaagggttttaaatgtaatgaga

SEQ ID NO: 2935 - DNA, 50 bp, Homo sapiens
ggggtaggttggttgttcagagtcttcccaataaagatgagtttttgagc

SEQ ID NO: 2936 - DNA, 50 bp, Homo sapiens
tgggcatagggacccatcattgatgactgatgaaaccatgtaataaagca

SEQ ID NO: 2937 - DNA, 50 bp, Homo sapiens
attttcctacagccctttgtacttcaaaatatgtttttgtgtccatcagt

SEQ ID NO: 2938 - DNA, 50 bp, Homo sapiens
tcagcactaactaaataaatttgttggttcagttgtacttgtcctgcaaa

SEQ ID NO: 2939 - DNA, 50 bp, Homo sapiens
agagggtggatcacacctcagtgggaagaaaaataaaatttccttcaggt

SEQ ID NO: 2940 - DNA, 50 bp, Homo sapiens
tgtgtaagtctgcctaaataggtagcttaaacttatgtcaaaatgtctgc

SEQ ID NO: 2941 - DNA, 50 bp, Homo sapiens
tcctttctgcttagtgaatgaatactggaatccatctgtgttgatacaat

SEQ ID NO: 2942 - DNA, 50 bp, Homo sapiens
gcaataccaagagaaaatgcacaaatatcactggatggagatgtcacatt

SEQ ID NO: 2943 - DNA, 50 bp, Homo sapiens
tggggatctcagggccaggagttatgttttgatttggaattttaattatt

SEQ ID NO: 2944 - DNA, 50 bp, Homo sapiens
ccagtaacttcgctctgttagaggtggaggattttcctatgttcccccca

SEQ ID NO: 2945 - DNA, 50 bp, Homo sapiens
tgctgaaaagattgtactttgtgatcccaatcagagggatggagctaatc

SEQ ID NO: 2946 - DNA, 50 bp, Homo sapiens
tcagactgctgagaaggaagaatttgaacatcaacagaaagagctggaga

SEQ ID NO: 2947 - DNA, 50 bp, Homo sapiens
tgggcagcttgggtaagtacgcaacttacttttccaccaaagaactgtca

SEQ ID NO: 2948 - DNA, 50 bp, Homo sapiens; identical to SEQ ID NO: 1651

SEQ ID NO: 2949 - DNA, 50 bp, Homo sapiens; identical to SEQ ID NO: 1702

SEQ ID NO: 2950 - DNA, 50 bp, Homo sapiens; identical to SEQ ID NO: 629

SEQ ID NO: 2951 - DNA, 50 bp, Homo sapiens
atgggccaggcagagaacagaactggaggcagtccatctagggaatggga

SEQ ID NO: 2952 - DNA, 50 bp, Homo sapiens
gtttcctttttgggtgaaatggatttatgtgagtgctttaaacaaatagc

SEQ ID NO: 2953 - DNA, 50 bp, Homo sapiens
gaacaatggagccagctgaaggaacagatttctgacatagatgacgcagt

SEQ ID NO: 2954 - DNA, 50 bp, Homo sapiens; identical to SEQ ID NO: 1747

SEQ ID NO: 2955 - DNA, 50 bp, Homo sapiens; identical to SEQ ID NO: 1664

SEQ ID NO: 2956 - DNA, 50 bp, Homo sapiens
agcacagatggtgcaatactttccttctttgaagagatcccaaagttagt

SEQ ID NO: 2957 - DNA, 50 bp, Homo sapiens
tggaagaatgtacagcttatggacaaatgtacacctttttgttactttaa

SEQ ID NO: 2958 - DNA, 50 bp, Homo sapiens
ttttggagcaaaaactatgggttgtaatttgaataaagtgtcactaagca

SEQ ID NO: 2959 - DNA, 50 bp, Homo sapiens
ttcagcaggaaaatgattcaatttttaaacaaaatgtaacagatggcagt

SEQ ID NO: 2960 - DNA, 50 bp, Homo sapiens
aagtagccaagctaagatgcctggctgggcttctgaggaattaatacact

SEQ ID NO: 2961 - DNA, 50 bp, Homo sapiens
ctgaccgccactctcacatttgggctcttcgctggccttggtggagctgg

SEQ ID NO: 2962 - DNA, 50 bp, Homo sapiens
tgcattgtgtagctagttttctggaaaagtcaatcttttaggaattgttt

SEQ ID NO: 2963 - DNA, 50 bp, Homo sapiens
acagctatactttgttgtgtaatgttatggttccctttctgtaaaatgtt

SEQ ID NO: 2964 - DNA, 50 bp, Homo sapiens
gacaggatcccccagagaccccatttgcctctcaacactcagaccttcaa

SEQ ID NO: 2965 - DNA, 50 bp, Homo sapiens
tttggtttaaaatgtaagataggaaaatgttggatatttgaggccatgct

SEQ ID NO: 2966 - DNA, 50 bp, Homo sapiens
aatctacattttcttaccaggagcagcattgaggtttttgagcatagtac

SEQ ID NO: 2967 - DNA, 50 bp, Homo sapiens
actaacccacgattctgagccctgagtatgcctggacattgatgctaaca

SEQ ID NO: 2968 - DNA, 50 bp, Homo sapiens
ttattctgcgtccccttctccaataaaacaagccagttgggcgtggttat

SEQ ID NO: 2969 - DNA, 50 bp, Homo sapiens
tccttcccactctctccaacatcacattcactttaaatttttctgtatat

SEQ ID NO: 2970 - DNA, 50 bp, Homo sapiens
agtcccaaaaaagccttgtgaaaatgttatgccctatgtaacagcagagt

SEQ ID NO: 2971 - DNA, 50 bp, Homo sapiens
aggggagggcactacacttccttgagagaaaccgctgtcattaataaaag

SEQ ID NO: 2972 - DNA, 50 bp, Homo sapiens
aggctgtagaaggaaatataccttaacaggctgatttggagtgacccaga

SEQ ID NO: 2973 - DNA, 50 bp, Homo sapiens
accagttacccaaaatctgattagaagtataaggtgctctgaagtgtcct

SEQ ID NO: 2974 - DNA, 50 bp, Homo sapiens
tgaggcttgtgaggccaatcaaaataatgtttgtgatctctactactgtt

SEQ ID NO: 2975 - DNA, 50 bp, Homo sapiens
cagttcccaaggacttgtcatttcatgttcttattttagacctgttttgt

SEQ ID NO: 2976 - DNA, 50 bp, Homo sapiens
accactagaagattccgggaacgttgggagtcacctgattctgcaaagat

SEQ ID NO: 2977 - DNA, 50 bp, Homo sapiens
gtcaagctgaccttgctgatggtgacattgcacctggatgtactatccaa

SEQ ID NO: 2978 - DNA, 50 bp, Homo sapiens
acagctcaagtaccctaatttagttcttttggactaatacaattcaggaa

SEQ ID NO: 2979 - DNA, 50 bp, Homo sapiens
gatgacgctgggcacagagggtcaggtcctgtcaagaggagctgggtgtc

SEQ ID NO: 2980 - DNA, 50 bp, Homo sapiens
aacatctctcttctccttcccaactactgcatgaagaaattctacttcca

SEQ ID NO: 2981 - DNA, 50 bp, Homo sapiens
ttcctgcctggattatttaaaaagccatgtgtggaaacccactatttaat

SEQ ID NO: 2982 - DNA, 50 bp, Homo sapiens
tgctacatttccaaggtgaagatgtgtgggcacatgttatggcagattga

SEQ ID NO: 2983 - DNA, 50 bp, Homo sapiens
acaaccatcaacattgctgttcaaagaaattacagtttacgtccattcca

SEQ ID NO: 2984 - DNA, 50 bp, Homo sapiens
cccacccataggccctgtccatacccatgtaaggtgttcaataaagaaca

SEQ ID NO: 2985 - DNA, 50 bp, Homo sapiens
actcttcaggagcttggcatcatggactgttaatgtatgtgattttcccc

SEQ ID NO: 2986 - DNA, 50 bp, Homo sapiens
ggtcaagggtgtcctccactctttaacagctgctggacagacacattaga

SEQ ID NO: 2987 - DNA, 50 bp, Homo sapiens
gcaacttcatgtcaactttctggctcctcaaacagtaggttggcagtaag

SEQ ID NO: 2988 - DNA, 50 bp, Homo sapiens
ccaagtggagacggggatggggaaaaatactgattctgtggaaaataccc

SEQ ID NO: 2989 - DNA, 50 bp, Homo sapiens; identical to SEQ ID NO: 1684

SEQ ID NO: 2990 - DNA, 50 bp, Homo sapiens
gcaggggctccagcaacaaaaaagaaacagcaacagaaaaagaagaaagg

SEQ ID NO: 2991 - DNA, 50 bp, Homo sapiens
agactcacttaccctcttggaaagctggtacagaaggaagtctgtggctg

SEQ ID NO: 2992 - DNA, 50 bp, Homo sapiens
cctggtcattggtggatgttaaacccatattcctttcaactgctgcctgc

SEQ ID NO: 2993 - DNA, 50 bp, Homo sapiens
aatgaattggcctggctaccactgtggtcgcgtgctacaggtttgacaaa

SEQ ID NO: 2994 - DNA, 50 bp, Homo sapiens
ttgatttgccataagtcttcccttgcttgcatcttccaaagctatttcga

SEQ ID NO: 2995 - DNA, 50 bp, Homo sapiens
agtgaagttacagtggaaatgagtggagggggattgtctttcaacgcagc

SEQ ID NO: 2996 - DNA, 50 bp, Homo sapiens
gcttggtcattatgaaccaggtgagcaatgcctacctataccgcaagagg

SEQ ID NO: 2997 - DNA, 50 bp, Homo sapiens
aaggcactgaaaatataaaaggactggtagtttactgatgtagatgtgaa

SEQ ID NO: 2998 - DNA, 50 bp, Homo sapiens
gcagaaaaggggaactcatttagctcacgagtggtcgagtgaagattgaa

SEQ ID NO: 2999 - DNA, 50 bp, Homo sapiens
tatcttgagacgccttacaaatgatggaggattccaaagagtttttgttt

SEQ ID NO: 3000 - DNA, 50 bp, Homo sapiens
aaaatgttgttgtgtacataccatgctttcaatgttggcttccaagtttt

SEQ ID NO: 3001 - DNA, 50 bp, Homo sapiens
ggtagaatgtgctcttctatatctactcctcaataaagcatgttctctgc

SEQ ID NO: 3002 - DNA, 50 bp, Homo sapiens
ccacaagaggatttaagggaggaatgtttataggacacacacacaaaagc

SEQ ID NO: 3003 - DNA, 50 bp, Homo sapiens
ctccagcagggtcagccattcacacccatccactcacctcccattcccag

SEQ ID NO: 3004 - DNA, 50 bp, Homo sapiens
aaactggcagaatgtccgggccttatatatcaagagcaccatgggcaagc

SEQ ID NO: 3005 - DNA, 50 bp, Homo sapiens; identical to SEQ ID NO: 1797

SEQ ID NO: 3006 - DNA, 50 bp, Homo sapiens
tgggagtgaggatgggaatgctgtatctgtggaagtcatgttatactgga

SEQ ID NO: 3007 - DNA, 50 bp, Homo sapiens
tgcttagatcactgcagcttctaggacccggtttcttttactgatttaaa

SEQ ID NO: 3008 - DNA, 50 bp, Homo sapiens
ctgaactaccaaatagctgtgggctttctggaactgctggctgggttgct

SEQ ID NO: 3009 - DNA, 50 bp, Homo sapiens
gctctgtgactttaagagaagaaggggggaggggtcccggattttatgtt

SEQ ID NO: 3010 - DNA, 50 bp, Homo sapiens
agaaatgtccttctttcactctgcatctttcttttctttgagtcgttttt

SEQ ID NO: 3011 - DNA, 50 bp, Homo sapiens
tccagataaagcaagaatagttgcaagaagtaaattctggcacaaagcgt

SEQ ID NO: 3012 - DNA, 50 bp, Homo sapiens
cccacaatggctttgattatgatttccccctgctgtgtgccgagctgcgg

SEQ ID NO: 3013 - DNA, 50 bp, Homo sapiens
aaattacagaaacatgttaaaggccggacaaaggaaagacaataaaatca

SEQ ID NO: 3014 - DNA, 50 bp, Homo sapiens
gaagtacgcggtcaaggcctgaggggcgcattgtcaataaagcacagctg

SEQ ID NO: 3015 - DNA, 50 bp, Homo sapiens
tctacagccatgtcctattccttgatcatccaaagcacctgcagagtcca

SEQ ID NO: 3016 - DNA, 50 bp, Homo sapiens
aatgtagcttaatcataatctcacactgaagattttgcatcacttttgct

SEQ ID NO: 3017 - DNA, 50 bp, Homo sapiens
tgatgatgatgttcaaagagaaagaaatggagtgattcagcacacaggcg

SEQ ID NO: 3018 - DNA, 50 bp, Homo sapiens
gccaccagccaagcaaccccctaaaacattcatatctaggcagtattttg

SEQ ID NO: 3019 - DNA, 50 bp, Homo sapiens
gcctttaccatgttctctccacatccgtaaataaacttccttcactacaa

SEQ ID NO: 3020 - DNA, 50 bp, Homo sapiens
ccacacctggcgagtaggccaagaaggaaaatctgacgaataaagacccc

SEQ ID NO: 3021 - DNA, 50 bp, Homo sapiens
gggctgagccccgcccagctcccctccacaataaacgctgtttctccttg

SEQ ID NO: 3022 - DNA, 50 bp, Homo sapiens
tttctcagcctacaaattgtgtctatacatttctaagccttgtttgcaga

SEQ ID NO: 3023 - DNA, 50 bp, Homo sapiens
gagcccacccccagcacccccatctgttaataaatatctcaactccaaaa

SEQ ID NO: 3024 - DNA, 50 bp, Homo sapiens
tggagtgatttcacagtgtgtactgttttgccacatacttctaaagaaca

SEQ ID NO: 3025 - DNA, 50 bp, Homo sapiens
ccctttggaaatggtgaaggaaccagcccaatagaagtacagagccagct

SEQ ID NO: 3026 - DNA, 50 bp, Homo sapiens
ctccctcaaggctgggaggagataaacaccaacccaggaattctcaataa

SEQ ID NO: 3027 - DNA, 50 bp, Homo sapiens
agggactgaaattgtggggggaaggtaggaggcacatcaataaagaggaa

SEQ ID NO: 3028 - DNA, 50 bp, Homo sapiens
tggggcaaaaccttgctaattttctcaaaagcatttatcattcttgttgc

SEQ ID NO: 3029 - DNA, 50 bp, Homo sapiens
cccccagtgtgcaagggcagtgaagacttgattgtacaaaatacgttttg

SEQ ID NO: 3030 - DNA, 50 bp, Homo sapiens
agatggcgagaacctaagtttcagttgattttacaattgaaatgactaaa

SEQ ID NO: 3031 - DNA, 50 bp, Homo sapiens
tgtcagaccttcttccacagcaaatgagatgtatgcccaaagcggtagaa

SEQ ID NO: 3032 - DNA, 50 bp, Homo sapiens
gttgcagggcgaggtcaagagagttctgacctggatggcccatagacctg

SEQ ID NO: 3033 - DNA, 50 bp, Homo sapiens
gacagcaggattggatgttgtgtattgtggtttattttattttcttcatt

SEQ ID NO: 3034 - DNA, 50 bp, Homo sapiens
agtgccttccctgcctgtgggggtcatgctgccacttttaatgggtcctc

SEQ ID NO: 3035 - DNA, 50 bp, Homo sapiens
tttggagtttttctgaaaaatggagcagtaatgcagcatcaacctattaa

SEQ ID NO: 3036 - DNA, 50 bp, Homo sapiens
caatggacaagtatttcctaatggtaccagaccactggacaggcttgggt

SEQ ID NO: 3037 - DNA, 50 bp, Homo sapiens
gtgttggagaggggctgtgtctgggtgagggatggcggggtactgatttt

SEQ ID NO: 3038 - DNA, 50 bp, Homo sapiens
gtgctttgagggtcagcctttaggaaggtgcagctttgttgtcctttgag

SEQ ID NO: 3039 - DNA, 50 bp, Homo sapiens
ggctcacatcaaaaggctaataggtgaatttgaccaacagcaagcagagt

SEQ ID NO: 3040 - DNA, 50 bp, Homo sapiens
cagaaagcaaacaacacaattacaaggttgaatctgaggaaaataatcct

SEQ ID NO: 3041 - DNA, 50 bp, Homo sapiens
tctctctgtgttctctgtattgtactaaccaacctcccaaatcgctgagc

SEQ ID NO: 3042 - DNA, 50 bp, Homo sapiens
cctggaataaaactcaacatgcagatttgcctactcatagggactttgcc

SEQ ID NO: 3043 - DNA, 50 bp, Homo sapiens
tgcctccctgatggaaaactatataaaattgtagacttaaaaggtttgtg

SEQ ID NO: 3044 - DNA, 50 bp, Homo sapiens
ttcattgtaaagatgttgatggtctcaataaaatgctaacttgccagtga

SEQ ID NO: 3045 - DNA, 50 bp, Homo sapiens
cgtccgcacggtacgtcttcatgggagtcattttattccttacagcttcc

SEQ ID NO: 3046 - DNA, 50 bp, Homo sapiens
tggtgtttggtttggggtgttttttaagttttttcttttatatcatccag

SEQ ID NO: 3047 - DNA, 50 bp, Homo sapiens
ctccctgctcttggttctcctctagattgaagtttgttttctgatgctgt

SEQ ID NO: 3048 - DNA, 50 bp, Homo sapiens
tgaagacatagttcacctaaaatggcatcctgctctgaatctagactttt

SEQ ID NO: 3049 - DNA, 50 bp, Homo sapiens
ccctttgagatttgtgtttgtgtcctgctttgagctgtaccttgtccagt

SEQ ID NO: 3050 - DNA, 50 bp, Homo sapiens; identical to SEQ ID NO: 477

SEQ ID NO: 3051 - DNA, 50 bp, Homo sapiens
ccagtgacacctctgaaagcccccattccctgagaatcctgttgttagta

SEQ ID NO: 3052 - DNA, 50 bp, Homo sapiens
cctggtcagtggtggtcttcaagacgacagctctgtatctgccatgtgaa

SEQ ID NO: 3053 - DNA, 50 bp, Homo sapiens
cccacttcccatgctggatgggcagaagacattgcttattggagacaaat

SEQ ID NO: 3054 - DNA, 50 bp, Homo sapiens
ttactggcatatgttttgtagactgtttaatgactggatatcttccttca

SEQ ID NO: 3055 - DNA, 50 bp, Homo sapiens
aatgtaaggttgttttgggggatggagttagaaccttaatgataatttct

SEQ ID NO: 3056 - DNA, 50 bp, Homo sapiens
tttggagtgggcaaagtaacctcttgcttggtgcaactatttgtttcaaa

SEQ ID NO: 3057 - DNA, 50 bp, Homo sapiens
gcttataaacacatttgaggaataggaggtccgggttttccataatgggt

SEQ ID NO: 3058 - DNA, 50 bp, Homo sapiens
tcttatcattgcatacattttctggatgcttgagccatcagatatcagct

SEQ ID NO: 3059 - DNA, 50 bp, Homo sapiens; identical to SEQ ID NO: 989

SEQ ID NO: 3060 - DNA, 50 bp, Homo sapiens
tgcattattgtgtagccacggttttctggaaaagttgatattttaggaat

SEQ ID NO: 3061 - DNA, 50 bp, Homo sapiens
attacattggaagggagctttcaagatggtaggatattgactaactgagc

SEQ ID NO: 3062 - DNA, 50 bp, Homo sapiens
catggtacaggcttggagcttgcaggtccctttctactgtggtgttggag

SEQ ID NO: 3063 - DNA, 50 bp, Homo sapiens
tgtgcagggacagttggcttccagaggtttcagctttcagttatttgaga

SEQ ID NO: 3064 - DNA, 50 bp, Homo sapiens
aattccattttattgggaacccattttccacctggtctttcttgacaggg

SEQ ID NO: 3065 - DNA, 50 bp, Homo sapiens
aaataaacttgtgtggtaaaagtacatgccatgtgtccctcaactgaaaa

SEQ ID NO: 3066 - DNA, 50 bp, Homo sapiens
ttcaagacaattttaattgtgaacctaccatgttgcctcccatcttctga

SEQ ID NO: 3067 - DNA, 50 bp, Homo sapiens
tttgtaagagctgggagcaaacacgtttatgagtgtgtcggaatcccgtg

SEQ ID NO: 3068 - DNA, 50 bp, Homo sapiens
cccaaacaggcatgtatcaaaacacctgtggagtactttagactccaaca

SEQ ID NO: 3069 - DNA, 50 bp, Homo sapiens
tggggccaaaagtccagtgaaattgtaagcttcaataaaaggatgaaact

SEQ ID NO: 3070 - DNA, 50 bp, Homo sapiens
tgggctggagtagaggactctggtgggaaggttttgctgctaatgtattt

SEQ ID NO: 3071 - DNA, 50 bp, Homo sapiens
agctaaacagtacttaaatagcggttggaactaggtagcctttcgaattt

SEQ ID NO: 3072 - DNA, 50 bp, Homo sapiens
tgtcattcatttttcagaatataaccactcaagctactggcacatagtga

SEQ ID NO: 3073 - DNA, 50 bp, Homo sapiens
tctgatagagaaaaagactgctttgtcactcaaacatgttccttcgacct

SEQ ID NO: 3074 - DNA, 50 bp, Homo sapiens; identical to SEQ ID NO: 1404

SEQ ID NO: 3075 - DNA, 50 bp, Homo sapiens
tttgatgttaaacagtaaatgccagtagtgaccaagaacacagtgattat

SEQ ID NO: 3076 - DNA, 50 bp, Homo sapiens
cctttgcctttatactttaggggtcttactccattaattcatttgttaca

SEQ ID NO: 3077 - DNA, 50 bp, Homo sapiens
tgcacgttatggtgtttctccctctcactgtctgagagtttagttgtagc

SEQ ID NO: 3078 - DNA, 50 bp, Homo sapiens
ctgtagagagtcttcaagatcccggagtggtagcgctgtctcctggtgaa

SEQ ID NO: 3079 - DNA, 50 bp, Homo sapiens; identical to SEQ ID NO: 960

SEQ ID NO: 3080 - DNA, 50 bp, Homo sapiens
gatccagaatccactctccagtctccctcccctgactccctctgctgtcc

SEQ ID NO: 3081 - DNA, 50 bp, Homo sapiens
attccattctattgtttacacaacgattactcgaagatgactgcaaaggt

SEQ ID NO: 3082 - DNA, 50 bp, Homo sapiens
agccaagaagagagcattaaacccaagaacattgtggagaagattgactt

SEQ ID NO: 3083 - DNA, 50 bp, Homo sapiens
tatattgtacttactgtgacagcagataataaaccagtctcttggagggc

SEQ ID NO: 3084 - DNA, 50 bp, Homo sapiens
cttattctcccattgggcagctgaggaccgaggcacagaggtgcggtgac

SEQ ID NO: 3085 - DNA, 50 bp, Homo sapiens
tcactgtataccactggagttttctggttatctctcgtatagcaaaatct

SEQ ID NO: 3086 - DNA, 50 bp, Homo sapiens
gctgccacctcctgttcatttagaactatgcaaagactccgcttccgttt

SEQ ID NO: 3087 - DNA, 50 bp, Homo sapiens
acagcaaagccccaactaatctttagaagcatattggaactgataactcc

SEQ ID NO: 3088 - DNA, 50 bp, Homo sapiens; identical to SEQ ID NO: 530

SEQ ID NO: 3089 - DNA, 50 bp, Homo sapiens
gtcaacatcatccggcaccctctggggtaggagaacagccattccacatg

SEQ ID NO: 3090 - DNA, 50 bp, Homo sapiens
tcatatgtgtggttatactcataataatgggccttgtaagccttttcacc

SEQ ID NO: 3091 - DNA, 50 bp, Homo sapiens
ctgcttgactcaccggcttcctatttgatgcacccaggcccccttgtggc

SEQ ID NO: 3092 - DNA, 50 bp, Homo sapiens
gggacagaaacacaaacgcaaaaaattcagacaaaagcagtaatgtttaa

SEQ ID NO: 3093 - DNA, 50 bp, Homo sapiens
gcgatcctcatcccttcagcaatatgtatttgagttcacactatttctgt

SEQ ID NO: 3094 - DNA, 50 bp, Homo sapiens
ttttgaacagcgaaaccagcgtttgcgagggagccccaatttcacaccag

SEQ ID NO: 3095 - DNA, 50 bp, Homo sapiens
ttccaaaagaaaaactagttgcagtcagggagccagcgaaaagacaaaaa

SEQ ID NO: 3096 - DNA, 50 bp, Homo sapiens
actgagagtggtgtctggatatattccttttgtcttcatcactttctgaa

SEQ ID NO: 3097 - DNA, 50 bp, Homo sapiens
gcatgcattcattggttgttcaataagtgagatgattacagataatactg

SEQ ID NO: 3098 - DNA, 50 bp, Homo sapiens
ctgatttcataaccaggccggaccacgtgcaatagggtggaaaccaaact

SEQ ID NO: 3099 - DNA, 50 bp, Homo sapiens
gaagacgacgcggattactactgctctgttggctacggctttagtcccta

SEQ ID NO: 3100 - DNA, 50 bp, Homo sapiens
tgaacctcagcccattaggcaggaaaagttgatatttaataaacaaggaa

SEQ ID NO: 3101 - DNA, 50 bp, Homo sapiens
ccaaggcacttggtttttctgttttatatactaataatcagggcctaagt

SEQ ID NO: 3102 - DNA, 50 bp, Homo sapiens
gggggccattcgattcgcctcagttgctgctgtaataaaagtctactttt

SEQ ID NO: 3103 - DNA, 50 bp, Homo sapiens
actttaagaaaaaacaaataattgttgcagaggtctctgtattttgcagc

SEQ ID NO: 3104 - DNA, 50 bp, Homo sapiens
ctgtaccagtgctggctgcaggtattaagtccaagtttattaactagata

SEQ ID NO: 3105 - DNA, 50 bp, Homo sapiens
gccacctctgtgttcctgtcatagcaaatatgggaccatcaccagcttac

SEQ ID NO: 3106 - DNA, 50 bp, Homo sapiens
tcctgaggtgatatacttcatatttgtaatcaactgaaagagctgtgcat

SEQ ID NO: 3107 - DNA, 50 bp, Homo sapiens
tgctgggtttgccatctttttgttttctttgaaaagcagcttagttaccc

SEQ ID NO: 3108 - DNA, 50 bp, Homo sapiens
ccactagttgatgtatggtatctttagatatttgcctgtctgtttgctca

SEQ ID NO: 3109 - DNA, 50 bp, Homo sapiens
aatggcctacaaccaagctatttgtcccctactttgagtcttaactgtgg

SEQ ID NO: 3110 - DNA, 50 bp, Homo sapiens
atcctgagctgcacttacctgtgagagtcttcaaacttttaaaccttgcc

SEQ ID NO: 3111 - DNA, 50 bp, Homo sapiens
tgctctgagatggggaacagaacacacaagtatgaagtttctttcaggtg

SEQ ID NO: 3112 - DNA, 50 bp, Homo sapiens
aagcacacccgtggttgtgaaaatagtatagcaaaaaagaaaaatccccg

SEQ ID NO: 3113 - DNA, 50 bp, Homo sapiens
tgtttacctgcttgcagcatattagaacagacgatccatgctaatattgt

SEQ ID NO: 3114 - DNA, 50 bp, Homo sapiens
aatccttacttaaaattcttccgttaccacccttgaaacaattagctttt

SEQ ID NO: 3115 - DNA, 50 bp, Homo sapiens
ataacagttctatttggaatgatacccacaactctacaagcatcttatcc

SEQ ID NO: 3116 - DNA, 50 bp, Homo sapiens
agagatttgtacatttgtgtaataggccttttcatgctttatgtgtagct

SEQ ID NO: 3117 - DNA, 50 bp, Homo sapiens
tcttggtgtatttcttatgcaaacaatcttcaggcagcaaagatgtctgt

SEQ ID NO: 3118 - DNA, 50 bp, Homo sapiens
aacctgtactgttggtattgtgttagtgtatggaccaatactgcctgtaa

SEQ ID NO: 3119 - DNA, 50 bp, Homo sapiens
aattgagggaccatcagataactgtattttgtcaggtgcaataaaaacaa

SEQ ID NO: 3120 - DNA, 50 bp, Homo sapiens
ctatgtgtactcctcatccctcctgctgtatattttctcattttttgcgt

SEQ ID NO: 3121 - DNA, 50 bp, Homo sapiens
ttaaaagtaacaaaaactgccatttgacagtaaaggctcttggcttctgt

SEQ ID NO: 3122 - DNA, 50 bp, Homo sapiens
gctcccttctctttgatagcagttataatgcccttgttcccaataaaact

SEQ ID NO: 3123 - DNA, 50 bp, Homo sapiens
ctgagatactgctgctggaatgggcgagacattgctgcaaagaagtcaag

SEQ ID NO: 3124 - DNA, 50 bp, Homo sapiens
ctgcggcgtgttaggaatgacctggaattgtcaataaacagatgctgctg

SEQ ID NO: 3125 - DNA, 50 bp, Homo sapiens
agctccctagctgaacgggttaccctggtcattaataaagctgtgactgg

SEQ ID NO: 3126 - DNA, 50 bp, Homo sapiens
ctcatctaaagacaccttcctttccactggctgtcaagccacagggcacc

SEQ ID NO: 3127 - DNA, 50 bp, Homo sapiens
ggcagaatccacaccagcttatcaaccaacacagctaattttagaatagg

SEQ ID NO: 3128 - DNA, 50 bp, Homo sapiens
gacaggacagtgaccttgggaggaaggggctactccgccatccttaaaag

SEQ ID NO: 3129 - DNA, 50 bp, Homo sapiens
ggacaagttggaacagaagaccaagagtggcctcactggatacatcaagg

SEQ ID NO: 3130 - DNA, 50 bp, Homo sapiens
ccccaattctgtggcgcatccagattgtgaaaatgtacaataaatgtgta

SEQ ID NO: 3131 - DNA, 50 bp, Homo sapiens
ttcagagaactttttgcatgcttatggttgatcagttaaaaaagaatgtt

SEQ ID NO: 3132 - DNA, 50 bp, Homo sapiens
tgctgtttctgtagccatattgtattctgtgtcaaataaagtccagttgg

SEQ ID NO: 3133 - DNA, 50 bp, Homo sapiens
acgccacccaaacctttcactttccaaagagctagccgtcctccacccag

SEQ ID NO: 3134 - DNA, 50 bp, Homo sapiens
gcatctgagatcctgttggaaaccacagcaacctgtattcattattagga

SEQ ID NO: 3135 - DNA, 50 bp, Homo sapiens
ggacgtgacctgtgctgagggctgtgagaatgtgaaacaacagtgtgaaa

SEQ ID NO: 3136 - DNA, 50 bp, Homo sapiens
gccatcagattgatcttcttcacaccaagctctgtttacattccgagagg

SEQ ID NO: 3137 - DNA, 50 bp, Homo sapiens
cctttcctcacagggaccaagacaaagcatgggacatgaaattaagagtg

SEQ ID NO: 3138 - DNA, 50 bp, Homo sapiens
aagcatgattcccacaaggactaagtatcagtgatttgtaattttcctgt

SEQ ID NO: 3139 - DNA, 50 bp, Homo sapiens
acctgttggttttaatgtgcatgtgaatggcctagagaacctatttttgt

SEQ ID NO: 3140 - DNA, 50 bp, Homo sapiens
ccgaccaagatccctccctgcaagacagatgggaatgtgtataataacta

SEQ ID NO: 3141 - DNA, 50 bp, Homo sapiens; identical to SEQ ID NO: 890

SEQ ID NO: 3142 - DNA, 50 bp, Homo sapiens
ggacggtgtccccgcacgtttgtattgtgtataaatacattcattaataa

SEQ ID NO: 3143 - DNA, 50 bp, Homo sapiens
atcctttcctcaacctcctcctttcccaattaatttcaaccatagtacga

SEQ ID NO: 3144 - DNA, 50 bp, Homo sapiens
gccagctatgtcctctaggaaatgacagacccaaccaccagcaataaaca

SEQ ID NO: 3145 - DNA, 50 bp, Homo sapiens
ctgtaaaaagacaattcatctcattgtgagtggaagtagttatctggaat

SEQ ID NO: 3146 - DNA, 50 bp, Homo sapiens
gcatttcagaatgtgtcttttgaagggctataccagttattaaatagtgt

SEQ ID NO: 3147 - DNA, 50 bp, Homo sapiens
ccagggtttctgcactggtcccctcttttcccttcagtcttcttcacttc

SEQ ID NO: 3148 - DNA, 50 bp, Homo sapiens
acactgctacaccattactttcttgagacatttgtaagtcctttgataca

SEQ ID NO: 3149 - DNA, 50 bp, Homo sapiens
tgaataactagtgataccctcaataaaacagggattgccaagaagggaac

SEQ ID NO: 3150 - DNA, 50 bp, Homo sapiens
acctttaacatgtaaagatgctcaccttgttcagaagagaataaaccagt

SEQ ID NO: 3151 - DNA, 50 bp, Homo sapiens
tatgtcataaacatgtaaataaaagatgttgaatcttgttgaaagcgcgg

SEQ ID NO: 3152 - DNA, 50 bp, Homo sapiens
ttgtattctggaagcgtgaattgcttttgaagtctgtcagtattactggt

SEQ ID NO: 3153 - DNA, 50 bp, Homo sapiens
tttgtaagcgaaggagatggaggtcgtcttaaaccagagagctactgaat

SEQ ID NO: 3154 - DNA, 50 bp, Homo sapiens
actcacaacttcttaagctaaatggtattttcatttttctcaagctctcc

SEQ ID NO: 3155 - DNA, 50 bp, Homo sapiens
agtttagcaatatgacattcttggtgacagtggaatctttgtctcttcac

SEQ ID NO: 3156 - DNA, 50 bp, Homo sapiens
gccactgaccttggctcaccttagaggaatttcctcgagaacaacagaga

SEQ ID NO: 3157 - DNA, 50 bp, Homo sapiens
acttctgtctttgctggaaagtgtatttgtgcataaataaagtctgtgta

SEQ ID NO: 3158 - DNA, 50 bp, Homo sapiens
ttctctttcttcacaatgtatgtcctcagtggtacctattattgatgcct

SEQ ID NO: 3159 - DNA, 50 bp, Homo sapiens
ctgtgacccgctcccgcctcatgagcaaggagagtggttcatcaatgatt

SEQ ID NO: 3160 - DNA, 50 bp, Homo sapiens; identical to SEQ ID NO: 77

SEQ ID NO: 3161 - DNA, 50 bp, Homo sapiens
agaacttccaaatgctgagcccagatccaaagttgtcttctgtccacgag

SEQ ID NO: 3162 - DNA, 50 bp, Homo sapiens
tgacaaattagaagaacggcctcacctgccatccaccttcaactacaacc

SEQ ID NO: 3163 - DNA, 50 bp, Homo sapiens
tggatattttaacctgttaagtgtgtgtgtgttttctgtacccaaccaga

SEQ ID NO: 3164 - DNA, 50 bp, Homo sapiens
taaatagggaagatggagacacctctgggggtcctctctgagtcaaatcc

SEQ ID NO: 3165 - DNA, 50 bp, Homo sapiens
tgtgttaggttgaataaggtgtggaaaatgcttttctgttagtagaatgc

SEQ ID NO: 3166 - DNA, 50 bp, Homo sapiens
gcagtaaccactgaacgtcaatcagccctccatggggttctttcgatttt

SEQ ID NO: 3167 - DNA, 50 bp, Homo sapiens
gtttgaagttgtgactctcctgctaccaattaaataaagcttactttgcc

SEQ ID NO: 3168 - DNA, 50 bp, Homo sapiens
tgcaagatgaatggctaatattttggtgcagtgtttgatgttcaaaacaa

SEQ ID NO: 3169 - DNA, 50 bp, Homo sapiens
ctgcctgttcagaactgtttaatagcagttactcttgagtgtatttacct

SEQ ID NO: 3170 - DNA, 50 bp, Homo sapiens
attctagagtttggaatgcaaaattaattgttttaccctcaagctgggaa

SEQ ID NO: 3171 - DNA, 50 bp, Homo sapiens
tggggtgaatttgttaaaatgagtaactttgataaagtttttcatgcaca

SEQ ID NO: 3172 - DNA, 50 bp, Homo sapiens
aaaagtatagagttggaaactctgggaaaacttacggaaatacacaaatg

SEQ ID NO: 3173 - DNA, 50 bp, Homo sapiens; identical to SEQ ID NO: 1619

SEQ ID NO: 3174 - DNA, 50 bp, Homo sapiens
tacaatgcttccaaactggaactctacattttgtatcttttaaagctcct

SEQ ID NO: 3175 - DNA, 50 bp, Homo sapiens; identical to SEQ ID NO: 1584

SEQ ID NO: 3176 - DNA, 50 bp, Homo sapiens; identical to SEQ ID NO: 1632

SEQ ID NO: 3177 - DNA, 50 bp, Homo sapiens
tggtgtttgattattggaatggtgccatattgtcactccttctacttgct

SEQ ID NO: 3178 - DNA, 50 bp, Homo sapiens; identical to SEQ ID NO: 1640

SEQ ID NO: 3179 - DNA, 50 bp, Homo sapiens
ggctaaacgattcttactcagtgtgatgtataatgatgcaacagggaccc

SEQ ID NO: 3180 - DNA, 50 bp, Homo sapiens; identical to SEQ ID NO: 1592

SEQ ID NO: 3181 - DNA, 50 bp, Homo sapiens
ataccttctgaacgggaagagacagccagcacagtgtttatgccactggt

SEQ ID NO: 3182 - DNA, 50 bp, Homo sapiens
ttccactagtatatccctgttgatttgtttgtgccttttattaactgcca

SEQ ID NO: 3183 - DNA, 50 bp, Homo sapiens
tcatctgtgccatgctctagaaccttgaccttgatagttcaccacgtctg

SEQ ID NO: 3184 - DNA, 50 bp, Homo sapiens
actgcccttaactctggtatacaccaaaaagaaatctttactttccttgt

SEQ ID NO: 3185 - DNA, 50 bp, Homo sapiens
aggcagcctttctttaatgttttcagttggtttgtattttgtagctcagt

SEQ ID NO: 3186 - DNA, 50 bp, Homo sapiens
ccagaatggtctttaatgagcatggaacctgagcaaagggaataggtggg

SEQ ID NO: 3187 - DNA, 50 bp, Homo sapiens
tctctctctacactgtggtgcacttaacttgtggaatttttatactaaaa

SEQ ID NO: 3188 - DNA, 50 bp, Homo sapiens
actcagcctaaggaaacaagtacactccacacatgcataaaggaaatcaa

SEQ ID NO: 3189 - DNA, 50 bp, Homo sapiens; identical to SEQ ID NO: 476

SEQ ID NO: 3190 - DNA, 50 bp, Homo sapiens
tttgcatcatgtagtcattgagtgagggggagatataagccaaggatttt

SEQ ID NO: 3191 - DNA, 50 bp, Homo sapiens
gcttacttcacaatgtgcccaggtcagctgtataaaataaatactgcatt

SEQ ID NO: 3192 - DNA, 50 bp, Homo sapiens
tgtaatggttggtttattgttctataaccccagcccatcattttctgtgt

SEQ ID NO: 3193 - DNA, 50 bp, Homo sapiens
agtcaatgtttcgtgttccgcattatttgaaccatttgcccttacagaaa

SEQ ID NO: 3194 - DNA, 50 bp, Homo sapiens
agggagcagtgcttttgggtcctagaacctgttgagtttctaatgaatat

SEQ ID NO: 3195 - DNA, 50 bp, Homo sapiens
aatgacttgttatagctcagtgtgcccttgaatccatacagtttcttaaa

SEQ ID NO: 3196 - DNA, 50 bp, Homo sapiens
tgttttgttttctgggttttgttttttgtttttgtctgtgcaagacctgc

SEQ ID NO: 3197 - DNA, 50 bp, Homo sapiens; identical to SEQ ID NO: 455

SEQ ID NO: 3198 - DNA, 50 bp, Homo sapiens
cctgacctgtgcaataaggattgttccctgcgaagttttgttggatgtaa

SEQ ID NO: 3199 - DNA, 50 bp, Homo sapiens
gagtctggggtaagggtgggggttgaaagttgttatctttaaatacatgt

SEQ ID NO: 3200 - DNA, 50 bp, Homo sapiens
ttgatctgccaaggatttcctctcagagctgttgcacagacagagattgt

SEQ ID NO: 3201 - DNA, 50 bp, Homo sapiens
gggggtttccacaatgtgagggggaaccaagaaaattttaaatacagtgt

SEQ ID NO: 3202 - DNA, 50 bp, Homo sapiens
tgcctgtcccaagttttgttccattttttaaaaatttgttgtaaactgca

SEQ ID NO: 3203 - DNA, 50 bp, Homo sapiens
tattgttacatatgtttgcatcaagctagcagccaagaggttaattgtgc

SEQ ID NO: 3204 - DNA, 50 bp, Homo sapiens
aaaccagaacaagcaacaaactgtatttatgcaagcaaaattgatgagaa

SEQ ID NO: 3205 - DNA, 50 bp, Homo sapiens
tgatgtttctgaatactaccaaacagccatacatgtctgcaatgaagaga

SEQ ID NO: 3206 - DNA, 50 bp, Homo sapiens
tatcatcctccttctcaacccatctccctaaccccacatgcttgccagtt

SEQ ID NO: 3207 - DNA, 50 bp, Homo sapiens
ttctgaaattgggaaacatttattttaaatgcaatcaggtagtgttgctt

SEQ ID NO: 3208 - DNA, 50 bp, Homo sapiens
gactgaatttgacatctggtatgctggtatgtagctcatacatcaagagt

SEQ ID NO: 3209 - DNA, 50 bp, Homo sapiens
ttgtacttttcagaaccattttgtctcattattcctgttttagctgaaga

SEQ ID NO: 3210 - DNA, 50 bp, Homo sapiens
ctggctgtgtcacagggtgagccccaaaattggggttcagcgtgggaggc

SEQ ID NO: 3211 - DNA, 50 bp, Homo sapiens
aatggtcccctgtgtttgtagagaactcccttatacagagttttggttct

SEQ ID NO: 3212 - DNA, 50 bp, Homo sapiens
ttctttcatgtcctccctacttcctcagtgtcaatcagattaaagtgtgt

SEQ ID NO: 3213 - DNA, 50 bp, Homo sapiens
tttgaactttggtcatagagtcttcatatttcagtatttggtggtcccta

SEQ ID NO: 3214 - DNA, 50 bp, Homo sapiens
accctagagttactctcttttgggaacataaggaggtatacagaactgca

SEQ ID NO: 3215 - DNA, 50 bp, Homo sapiens
ttgatgtgtcacaaaacattactcatttgatttcccccacccccgccaac

SEQ ID NO: 3216 - DNA, 50 bp, Homo sapiens
tcagggcgtttgaatgtgaattaggaccagcgcaatgaatgctcaagttg

SEQ ID NO: 3217 - DNA, 50 bp, Homo sapiens
agttcccagtctcttctgtcctgcagcccttgcctctttcccacaggttc

SEQ ID NO: 3218 - DNA, 50 bp, Homo sapiens
gtagaatcaggcactgctcgcagaaggaacacagattgtagagattaaca

SEQ ID NO: 3219 - DNA, 50 bp, Homo sapiens
ttttctcagcgcagttttgttttgtgtgtccattggattacaaactttat

SEQ ID NO: 3220 - DNA, 50 bp, Homo sapiens
tgcctcattatcttgcagctgtaaacatattggaatgtacatgtcaataa

SEQ ID NO: 3221 - DNA, 50 bp, Homo sapiens
gccatagcctgaatcttttaggggtattaaggtcagcctctcactcttcc

SEQ ID NO: 3222 - DNA, 50 bp, Homo sapiens
agccgccttccaggcccgctatgcagacatctttccctccaaggtttgtc

SEQ ID NO: 3223 - DNA, 50 bp, Homo sapiens
agcagctttcttcaagtcgctctttagccctttgtggttaatctctcagt

SEQ ID NO: 3224 - DNA, 50 bp, Homo sapiens
tgcactgatacaacattaccattcttctatggaaagaaaacttttgatga

SEQ ID NO: 3225 - DNA, 50 bp, Homo sapiens
atagaggaggaggcacttcaggggtgaggcggaggaggagtcaacgtatt

SEQ ID NO: 3226 - DNA, 50 bp, Homo sapiens
atacccacacagcaactggtccactgctttactgtctgttggataatggc

SEQ ID NO: 3227 - DNA, 50 bp, Homo sapiens
agatttgtgtcctctcattccctctcttcctcttgtaagtgcccttctaa

SEQ ID NO: 3228 - DNA, 50 bp, Homo sapiens
gcactgtttttaaacccaagtaaagactgcttgaaacctgttgatggaaa

SEQ ID NO: 3229 - DNA, 50 bp, Homo sapiens
agatttcccctcagtttccattgacttagatcaggttacagagaaaggca

SEQ ID NO: 3230 - DNA, 50 bp, Homo sapiens
agatcgagatcttcagtcctctgcttcatctgtgagcttgccttcagtca

SEQ ID NO: 3231 - DNA, 50 bp, Homo sapiens; identical to SEQ ID NO: 1184

SEQ ID NO: 3232 - DNA, 50 bp, Homo sapiens
tggcactctgtggctccttgtagtattatagctatactgggaaagcatag

SEQ ID NO: 3233 - DNA, 50 bp, Homo sapiens; identical to SEQ ID NO: 1204

SEQ ID NO: 3234 - DNA, 50 bp, Homo sapiens
aattgaccaacctaatgttacaactactttgaggtggccaaatgtaaact

SEQ ID NO: 3235 - DNA, 50 bp, Homo sapiens
ctactacgctgccctgggtgctgtaggagcccatctgactcaccagaaat

SEQ ID NO: 3236 - DNA, 50 bp, Homo sapiens
aaggcctcagttttaattattttcttcccaaaataaatcacacatttggt

SEQ ID NO: 3237 - DNA, 50 bp, Homo sapiens
ggtggggtgatagggtgggctaaaaaccatgcactctggaatttgttgta

SEQ ID NO: 3238 - DNA, 50 bp, Homo sapiens
agaggcagcttctagacagagttgcttaatgaaagggtttgtaatacttt

SEQ ID NO: 3239 - DNA, 50 bp, Homo sapiens; identical to SEQ ID NO: 1582

SEQ ID NO: 3240 - DNA, 50 bp, Homo sapiens
caacggccaggagaagcactttaaggacgaggacgaggacgaggacgtgg

SEQ ID NO: 3241 - DNA, 50 bp, Homo sapiens
atacagccccggcagaaaacgcctaaagtcagatgagagaccagtacata

SEQ ID NO: 3242 - DNA, 50 bp, Homo sapiens
accagaaacttcaaatgtgtcacaaaagatgagcagaactatcccgaggt

SEQ ID NO: 3243 - DNA, 50 bp, Homo sapiens
aaagcgaagtcatgggagagccacacttgatggtggaatataaacttggt

SEQ ID NO: 3244 - DNA, 50 bp, Homo sapiens
tccctgccataacatcttttgccacgtatagctggaattaagtgttgtct

SEQ ID NO: 3245 - DNA, 50 bp, Homo sapiens
ctggtgactccacacttccaacctgctctaaaaaacgcaaaatagaacag

SEQ ID NO: 3246 - DNA, 50 bp, Homo sapiens
tgtgtagtggatggagtttactgtttgtggaataaaaacggctgtttccg

SEQ ID NO: 3247 - DNA, 50 bp, Homo sapiens
acagggatttcttatgtctttggctacactagatattttgtgattggcaa

SEQ ID NO: 3248 - DNA, 50 bp, Homo sapiens
aggcctgagtgtgtgcgggagaccaaataaaccggcttgggtgcgcaaaa

SEQ ID NO: 3249 - DNA, 50 bp, Homo sapiens
aagaaagaagagagagaacttgatgccaagtccacgaaaaaacaattttt

SEQ ID NO: 3250 - DNA, 50 bp, Homo sapiens
gatccagctgtgcttaagagccagtaatgtcttaataaacatgtggcagc

SEQ ID NO: 3251 - DNA, 50 bp, Homo sapiens
aagcacttgttttattttgtgtgtggagtataaaggctacacccttattg

SEQ ID NO: 3252 - DNA, 50 bp, Homo sapiens
cctttttctacagaatcatcaggcatgggtaaggtggctaacgctgagat

SEQ ID NO: 3253 - DNA, 50 bp, Homo sapiens
tgggtatgttctagagatttaccaccattgcttattgcttttttctttaa

SEQ ID NO: 3254 - DNA, 50 bp, Homo sapiens
tcttcttgatagatgaggccatggtgtaaatggaagtttcagagaggaca

SEQ ID NO: 3255 - DNA, 50 bp, Homo sapiens
gtgggttggtcccactaatggaaatggaaatgcctgagccaggccagcgg

SEQ ID NO: 3256 - DNA, 50 bp, Homo sapiens
aatctattcctgcacctgttacggtttctggaagcagttaataaaaagta

SEQ ID NO: 3257 - DNA, 50 bp, Homo sapiens
gcatggagtcaggagaaaaccaccttcataaactgctctgtgcaaagagg

SEQ ID NO: 3258 - DNA, 50 bp, Homo sapiens
acaaatgcccctgtttatcaataggtgactacttactacacatggaacca

SEQ ID NO: 3259 - DNA, 50 bp, Homo sapiens
tgattatatgcagattcctagtagcatgccttacctacagcactatgtgc

SEQ ID NO: 3260 - DNA, 50 bp, Homo sapiens
ggtcattgagcctcaggtagggaatatatcaacccgatttcttcctctct

SEQ ID NO: 3261 - DNA, 50 bp, Homo sapiens
tttcaaagtgcccagactgtgtacaaagacacatgtaatggagattgtac

SEQ ID NO: 3262 - DNA, 50 bp, Homo sapiens
aggaccgaagtgtttcaagtggatctcagtaaaggatctttggagccaga

SEQ ID NO: 3263 - DNA, 50 bp, Homo sapiens
agtttcactgtcagagatattgtaggtgctaatactggatttcgtctcag

SEQ ID NO: 3264 - DNA, 50 bp, Homo sapiens
agttagaagagcaatatgtttccttctctgtaacagtgtcctaacagtga

SEQ ID NO: 3265 - DNA, 50 bp, Homo sapiens
agctgccacttcccagaagcctacataattatttgctctatgaagacgtt

SEQ ID NO: 3266 - DNA, 50 bp, Homo sapiens
gccactaataacattgggctaatatctgctgtgcttctctgacaggtagt

SEQ ID NO: 3267 - DNA, 50 bp, Homo sapiens
agcatgcagttctctgtgaaatctcaaatattgttgtaatagtctgtttc

SEQ ID NO: 3268 - DNA, 50 bp, Homo sapiens
tgaatctatcccccaagaaaccatcttatccctgtaataaatcagcatgt

SEQ ID NO: 3269 - DNA, 50 bp, Homo sapiens
gtgcttccaggcggcactgacagcctcagtaacaataaaaacaatggtag

SEQ ID NO: 3270 - DNA, 50 bp, Homo sapiens
gtccatgtttctaggggtattcatttgctttctcgttgaaacctgttgtt

SEQ ID NO: 3271 - DNA, 50 bp, Homo sapiens
taggtccataaatgttgtaataaatattcctttgatcttggtgtttgcgt

SEQ ID NO: 3272 - DNA, 50 bp, Homo sapiens
gctagtacctgttatttattacctggaggcctgtccagcacccaccctac

SEQ ID NO: 3273 - DNA, 50 bp, Homo sapiens
cccactatgcacagattaaacttcacctacaaactccttaatatgatctg

SEQ ID NO: 3274 - DNA, 50 bp, Homo sapiens
tgtgctctgttttaccttactctgtttagaaaagtatacaagcgtgtttt

SEQ ID NO: 3275 - DNA, 50 bp, Homo sapiens
tgagtgtgtctctggattttgaccccttattgattcattgtaatatgtaa

SEQ ID NO: 3276 - DNA, 50 bp, Homo sapiens
acatttgtaagggctctcaaagattcacacatgcctatattatcataaga

SEQ ID NO: 3277 - DNA, 50 bp, Homo sapiens
tccgcatccattatttaaaccagtggaaattgtctctatttttggaaagt

SEQ ID NO: 3278 - DNA, 50 bp, Homo sapiens
acggagctgtagtgccattagaaactgtgaatttccaaataaatctgaac

SEQ ID NO: 3279 - DNA, 50 bp, Homo sapiens
agccttcagtttcttaaatgaaatcaaatgttccttcagtacaggtaact

SEQ ID NO: 3280 - DNA, 50 bp, Homo sapiens
ccagacccccatcacttgatgggccacacaagtttgagagtggtacaagg

SEQ ID NO: 3281 - DNA, 50 bp, Homo sapiens
tcaggttaaacccagcagcagcaaagaactccccagtgacttccagttat

SEQ ID NO: 3282 - DNA, 50 bp, Homo sapiens
ggtgggcatttttgggctacctggttcgtttttataagattttgctgggt

SEQ ID NO: 3283 - DNA, 50 bp, Homo sapiens
agtgcaataatactgtatagctttcccccacctcccacaaaatcacccag

SEQ ID NO: 3284 - DNA, 50 bp, Homo sapiens
aatcatgttgcagaaccagcaggtggatagtatataggtttatgcctggg

SEQ ID NO: 3285 - DNA, 50 bp, Homo sapiens
ggtgcagcgtgtcagacacaacattcatgttactcttacattggaatctg

SEQ ID NO: 3286 - DNA, 50 bp, Homo sapiens
ggactgacaccacagatgacagccccacctccttgagctttatttaccta

SEQ ID NO: 3287 - DNA, 50 bp, Homo sapiens
acgacccattttgcaagacttaaagccggaagaacacattttcagattgt

SEQ ID NO: 3288 - DNA, 50 bp, Homo sapiens
aggaattactgtaacaaaatatgtatgtccgaagggaaaaagctgcaagg

SEQ ID NO: 3289 - DNA, 50 bp, Homo sapiens
tcctgtggaatctgatatgtctggtagcatgtcattgatgggacatgaag

SEQ ID NO: 3290 - DNA, 50 bp, Homo sapiens
atggcactaggcagcatttgtatagtaactaatggcaaaaattcatggct

SEQ ID NO: 3291 - DNA, 50 bp, Homo sapiens
atttgattaaaattatttcccactgacctaaactttcagtgatttgtggg

SEQ ID NO: 3292 - DNA, 50 bp, Homo sapiens
aaagcaagtgttttgtacatttcttttcaaaaagtgccaaatttgtcagt

SEQ ID NO: 3293 - DNA, 50 bp, Homo sapiens
aatctgcactgatattacatccacagtaccacagtatttatgtgtatgaa

SEQ ID NO: 3294 - DNA, 50 bp, Homo sapiens
atggtagctgagccaaacacgtaggatttccgttttaaggttcacatgga

SEQ ID NO: 3295 - DNA, 50 bp, Homo sapiens
aagccagaacctgctgttttcagggtgggtgatgtaaatatagtgtgtac

SEQ ID NO: 3296 - DNA, 50 bp, Homo sapiens; identical to SEQ ID NO: 3162

SEQ ID NO: 3297 - DNA, 50 bp, Homo sapiens
tctttctggtttctggagataacccatcaataaaagctgcttcctctggt

SEQ ID NO: 3298 - DNA, 50 bp, Homo sapiens
gggacccctcctacccttgactcctctgtgctttggtaataaattgtttt

SEQ ID NO: 3299 - DNA, 50 bp, Homo sapiens
gttctgaatgctgtcctcaaagtatataatgtttcatgtaccaagaccct

SEQ ID NO: 3300 - DNA, 50 bp, Homo sapiens
gacatctgctccctcctcctgcaacacagcccagccctgaaggccatccg

SEQ ID NO: 3301 - DNA, 50 bp, Homo sapiens
tgggaagatcctgacctcctccaaggaagaaatccagaaagccttaagac

SEQ ID NO: 3302 - DNA, 50 bp, Homo sapiens
agccagtgatctctctgactttcaatcagtttccaagcttaaccagggca

SEQ ID NO: 3303 - DNA, 50 bp, Homo sapiens
aaacgcatccgctatctctacaaacactttaaccgacatgggaagtttcg

SEQ ID NO: 3304 - DNA, 50 bp, Homo sapiens; identical to SEQ ID NO: 745

SEQ ID NO: 3305 - DNA, 50 bp, Homo sapiens
ttccaggcttttgctactcttcactcagctacaataaacatcctgaatgt

SEQ ID NO: 3306 - DNA, 50 bp, Homo sapiens
acacctagtcatagaaatcagtctctctggtttgttttgtattatgttgt

SEQ ID NO: 3307 - DNA, 50 bp, Homo sapiens
cactgcttccttctgctccaggcctcaattttcccttcttgtaaaatgga

SEQ ID NO: 3308 - DNA, 50 bp, Homo sapiens
actttcggagggagtttattattgagtctttatctgtgacagtatttgga

SEQ ID NO: 3309 - DNA, 50 bp, Homo sapiens
atagagaggtaattaaattgctggagccaactatttcacaacttctgtaa

SEQ ID NO: 3310 - DNA, 50 bp, Homo sapiens
gttccaccagtatttaccaggaaaacaaagaatgtgttaagggatgctcc

SEQ ID NO: 3311 - DNA, 50 bp, Homo sapiens
tgctatttcctattttcaccaaaattggggaaggagtgccactttccagc

SEQ ID NO: 3312 - DNA, 50 bp, Homo sapiens
tgctgccacttttcaattctgtcagtgcttccacatggaaacaaaatgca

SEQ ID NO: 3313 - DNA, 50 bp, Homo sapiens
tcactttctgtattttaattttgttgaagggctgattgggatttccatgt

SEQ ID NO: 3314 - DNA, 50 bp, Homo sapiens
gcatgaagagacatagccttttagttttgctaattgtgaaatggaaatgc

SEQ ID NO: 3315 - DNA, 50 bp, Homo sapiens
tgttgtccctgaacttagctaaatggtgcaacttagtttctccttgcttt

SEQ ID NO: 3316 - DNA, 50 bp, Homo sapiens
tcatagtgtcagtgaggtcccgtgagtctttgtgagtccttgtgtcatcg

SEQ ID NO: 3317 - DNA, 50 bp, Homo sapiens
gtgcgtagaatattacgtatgcatgttcatgtctaaagaatggctgttga

SEQ ID NO: 3318 - DNA, 50 bp, Homo sapiens; identical to SEQ ID NO: 1463

SEQ ID NO: 3319 - DNA, 50 bp, Homo sapiens
ggacattggttattttatgctttcttggatataaccatgatcagagtgcc

SEQ ID NO: 3320 - DNA, 50 bp, Homo sapiens
gcaagtgtaggagtggtgggcctgaactgggccattgatcagactaaata

SEQ ID NO: 3321 - DNA, 50 bp, Homo sapiens
aatcagaagagcctggaaaaagacctagcccaacttcccttgtgggaaac

SEQ ID NO: 3322 - DNA, 50 bp, Homo sapiens
tcaacaaaggggattttgtacacataacatgggttatttagtttaactct

SEQ ID NO: 3323 - DNA, 50 bp, Homo sapiens
cttttgtgcagcgactatgttggtgttaggggtggtgtggagattgttaa

SEQ ID NO: 3324 - DNA, 50 bp, Homo sapiens
atttatgccttaaatgttttcttccccattccttcctccccctcggtagg

SEQ ID NO: 3325 - DNA, 50 bp, Homo sapiens
tttgtatttgtgaactcatctgtgggaggagtaaagaaaatccaaaagca

SEQ ID NO: 3326 - DNA, 50 bp, Homo sapiens
cccccgtgggcatggaccacctttattttatacaaaattaaaaacaagtt

SEQ ID NO: 3327 - DNA, 50 bp, Homo sapiens
actgtaaactaatctgtcattgtttttaccttccttttctttttcagtgc

SEQ ID NO: 3328 - DNA, 50 bp, Homo sapiens
tacttgctgtggtggtcttgtgaaaggtgatgggttttattcgttgggct

SEQ ID NO: 3329 - DNA, 50 bp, Homo sapiens
aaagaattagtgtatgcttcctgaataaaaaggagccaaagttgatcaga

SEQ ID NO: 3330 - DNA, 50 bp, Homo sapiens; identical to SEQ ID NO: 1251

SEQ ID NO: 3331 - DNA, 50 bp, Homo sapiens
agcttaaggttttaaaaatgttgcccgtaatgttgaacgtgtctgttaga

SEQ ID NO: 3332 - DNA, 50 bp, Homo sapiens
ggatgcacgtacagaatacattcagccgtcaggtaataacatgaagcagt

SEQ ID NO: 3333 - DNA, 50 bp, Homo sapiens
ggacagtttctattgcttttccttttttccatcccttccctaccatcaaa

SEQ ID NO: 3334 - DNA, 50 bp, Homo sapiens
agacttacattactgctttaacgtgtatatcactgggcatccccaagggc

SEQ ID NO: 3335 - DNA, 50 bp, Homo sapiens
gtcaggttaggtcaaagccagggagtgacagaatctgggaaatcaaacaa

SEQ ID NO: 3336 - DNA, 50 bp, Homo sapiens
cctcttgatgcctaagcaggtaagcagatgcctaagctgtatttctccaa

SEQ ID NO: 3337 - DNA, 50 bp, Homo sapiens
tggatctgtcaaactaacacttatgcctttagtctcattgtatgaggtgt

SEQ ID NO: 3338 - DNA, 50 bp, Homo sapiens
acctgccatcattggtctttactaagtgaagtgacttctttctttaacaa

SEQ ID NO: 3339 - DNA, 50 bp, Homo sapiens
gctgccaactgtagtaatgatgcttttaataaaagtgacccatgatatgc

SEQ ID NO: 3340 - DNA, 50 bp, Homo sapiens
actgttgtccccccacccttttttccttaaataaagtaaaaatgacaccc

SEQ ID NO: 3341 - DNA, 50 bp, Homo sapiens
tgtgaatactgtgtagcaggatcttgagagtccttgttcttacataggca

SEQ ID NO: 3342 - DNA, 50 bp, Homo sapiens
aagaggcttccatccctccttccttctttcctcctacagtgctgagcaaa

SEQ ID NO: 3343 - DNA, 50 bp, Homo sapiens
gttgaattggggtggatggggggagcaagcataatttttaagtgtgaagc

SEQ ID NO: 3344 - DNA, 50 bp, Homo sapiens; identical to SEQ ID NO: 876

SEQ ID NO: 3345 - DNA, 50 bp, Homo sapiens
cccactgaagtctttgggtagctcttaagccataactaaggagcagcatt

SEQ ID NO: 3346 - DNA, 50 bp, Homo sapiens
agtgacgaggaggaagtggcctacacgggttagctgcccagtgagccatc

SEQ ID NO: 3347 - DNA, 50 bp, Homo sapiens
aacagaagtcaagagaacatagaccaacttgctgcatgagtaaggtggct

SEQ ID NO: 3348 - DNA, 50 bp, Homo sapiens
ttttccctgctattgaggaagtattttgccttccctactcactgagaagt

SEQ ID NO: 3349 - DNA, 50 bp, Homo sapiens
cggaaccagaatttgatctcaactatgttccactaaaggcacaggaatgg

SEQ ID NO: 3350 - DNA, 50 bp, Homo sapiens
cgcaccttgtgtcttgtagggtatggtatgtgggacttcgctgtttttat

SEQ ID NO: 3351 - DNA, 50 bp, Homo sapiens
agcagttatattgccccttggtttttattcagtttaactactgtttccaa

SEQ ID NO: 3352 - DNA, 50 bp, Homo sapiens
agcaaaatcctcagaaatggtctaaataaaacacttgatatgcctagaga

SEQ ID NO: 3353 - DNA, 50 bp, Homo sapiens; identical to SEQ ID NO: 879

SEQ ID NO: 3354 - DNA, 50 bp, Homo sapiens
ttacctggattccattggctggttttaccactcctatcagattgtagtgt

SEQ ID NO: 3355 - DNA, 50 bp, Homo sapiens
ctctttgccctctatcctgagtaactaatggacatcttctcatgcaaggt

SEQ ID NO: 3356 - DNA, 50 bp, Homo sapiens
gccacagaatggtcacccagcttatttaggtgtagacaagtatgacacag

SEQ ID NO: 3357 - DNA, 50 bp, Homo sapiens
gccacagaggctccaatacctgggaatgttcacaaagtcatcaactggaa

SEQ ID NO: 3358 - DNA, 50 bp, Homo sapiens
agaatgtgtgtgcctgtgggtctctacaagtgacagatgtgttgttttca

SEQ ID NO: 3359 - DNA, 50 bp, Homo sapiens
tccaaattgtttcctaacattctattttatgcctttgcgtattaaacgtg

SEQ ID NO: 3360 - DNA, 50 bp, Homo sapiens
gcctctactgtggcctcaaccctggcaattatagctactcccatccctta

SEQ ID NO: 3361 - DNA, 50 bp, Homo sapiens
aactgaacacaattttgggacaacgtttaaacattacttttcatacttga

SEQ ID NO: 3362 - DNA, 50 bp, Homo sapiens
ctcagcccagcccgcctgtccctagattcagccacatcagaaataaactg

SEQ ID NO: 3363 - DNA, 50 bp, Homo sapiens
actgtgccatggacatttttcctctggggaattaacatctaaattctggt

SEQ ID NO: 3364 - DNA, 50 bp, Homo sapiens
acaacgctcttagagaatccgtgaatgtgaacagacaaatgtggctaacc

SEQ ID NO: 3365 - DNA, 50 bp, Homo sapiens
taggagaataagagtctggagactgggagccttcacttcggcctccgatt

SEQ ID NO: 3366 - DNA, 50 bp, Homo sapiens
tgctgagtggttacactttgcaagctgtggtgaagatcacactgtgaaga

SEQ ID NO: 3367 - DNA, 50 bp, Homo sapiens
cccagtgctgatggagatgccactttcgtgtgactgcgaacattaaagca

SEQ ID NO: 3368 - DNA, 50 bp, Homo sapiens
tgttcaggatctcctcccttgtttaaatgtcaataaatgccccaactgct

SEQ ID NO: 3369 - DNA, 50 bp, Homo sapiens
ttattcatatattcctgtccaaagccacactgaaaacagaggcagagaca

SEQ ID NO: 3370 - DNA, 50 bp, Homo sapiens
aggtcatccacacacttctgcccccactgcattgaattttttgcttatgt

SEQ ID NO: 3371 - DNA, 50 bp, Homo sapiens
ttttcgttctcctcctaccccagatctctacaaggacattgcccctaagc

SEQ ID NO: 3372 - DNA, 50 bp, Homo sapiens
gtgtttgtaattcttctttgtccttttacctacagaaatggtcacatggt

SEQ ID NO: 3373 - DNA, 50 bp, Homo sapiens
aggatgtttgtagtgctataatatagaatgggatttactctgctttacca

SEQ ID NO: 3374 - DNA, 50 bp, Homo sapiens
agctaattatctctttgagtccttgcttctgtttgctcacagtaagctca

SEQ ID NO: 3375 - DNA, 50 bp, Homo sapiens
tcctacttatttaagctatttgagctccgggtctcttctacctgcattct

SEQ ID NO: 3376 - DNA, 50 bp, Homo sapiens
agtgattgccacctaaatcagaagacgttctaaagtcagtaagaaagtgt

SEQ ID NO: 3377 - DNA, 50 bp, Homo sapiens
cacgcttagggcagggatctgggaaattccagtgatctcctttagcagag

SEQ ID NO: 3378 - DNA, 50 bp, Homo sapiens
tttctaatcgaggtgtgaaaaagttctaggttcagttgaagttctgatga

SEQ ID NO: 3379 - DNA, 50 bp, Homo sapiens
tcattctgtttttgatgaacatttggaaactgtcgggctttttattaaag

SEQ ID NO: 3380 - DNA, 50 bp, Homo sapiens
caatgccctgtgttaaattgtttaaaagtttcccttttcttttttgccaa

SEQ ID NO: 3381 - DNA, 50 bp, Homo sapiens
acctattgcatggaaagatgctcattatagtgaagttaataaagcacctt

SEQ ID NO: 3382 - DNA, 50 bp, Homo sapiens
agaggactatagtggaagtgaaagcattctgtgtttactctttgcattaa

SEQ ID NO: 3383 - DNA, 50 bp, Homo sapiens
tgaattgcactgtgaaaagcactcttccctctcagttttcgttcatcctg

SEQ ID NO: 3384 - DNA, 50 bp, Homo sapiens
ccatggggtcagaagggcacggtagttcttgcaattatttttgttttacc

SEQ ID NO: 3385 - DNA, 50 bp, Homo sapiens
aatgtgggaaggatttatttacagtgtgttgtaattttgtaaggccaact

SEQ ID NO: 3386 - DNA, 50 bp, Homo sapiens
agctactgtgacagaaacagaaaagcagtggacaacacgtttccaagaag

SEQ ID NO: 3387 - DNA, 50 bp, Homo sapiens
tgctcatgctgacttaaaacactagcagtaaaacgctgtaaactgtaaca

SEQ ID NO: 3388 - DNA, 50 bp, Homo sapiens
tccaatgcagtcccattctttatggcctatagtctcactcccaactaccc

SEQ ID NO: 3389 - DNA, 50 bp, Homo sapiens
ggtgtctgacttaatgactcctgctgaagttgaattgtgagatgttatcc

SEQ ID NO: 3390 - DNA, 50 bp, Homo sapiens
catttgtctggaaatgctgccgggagcctattgtgtaaatgtaggtattt

SEQ ID NO: 3391 - DNA, 50 bp, Homo sapiens; identical to SEQ ID NO: 814

SEQ ID NO: 3392 - DNA, 50 bp, Homo sapiens
caggtcaacccccaccggacctacaacccgcagtcccacatcatctcagg

SEQ ID NO: 3393 - DNA, 50 bp, Homo sapiens; identical to SEQ ID NO: 3392

SEQ ID NO: 3394 - DNA, 50 bp, Homo sapiens
tttagggttgtgactggctttggtgcaaatgtgtgctcaagctaataagt

SEQ ID NO: 3395 - DNA, 50 bp, Homo sapiens
acttgtgttttgtttgggggctgggaaatgtatttttacattgtagccaa

SEQ ID NO: 3396 - DNA, 50 bp, Homo sapiens
aacattgtgctctaacagtatgactattctttcccccactcttaaacagt

SEQ ID NO: 3397 - DNA, 50 bp, Homo sapiens
ccaagggaggagggaggaggtaaaaggcagggagttaataacatgaatta

SEQ ID NO: 3398 - DNA, 50 bp, Homo sapiens
tactctttggcatccagtctctcgtggcgattgattatgcttgtgtgagg

SEQ ID NO: 3399 - DNA, 50 bp, Homo sapiens
ccttccagaagctacgaaaaagggagctgtttaaatttaataaatctctg

SEQ ID NO: 3400 - DNA, 50 bp, Homo sapiens
aagtgccatagaagaccaataactgtttagttgaggctagtctggaacct

SEQ ID NO: 3401 - DNA, 50 bp, Homo sapiens
tggattcaagttactgaagtgaataccaataaaaagaaaaccctaggcca

SEQ ID NO: 3402 - DNA, 50 bp, Homo sapiens
aggagtggatcccaccttcaacaccttacaagtaaagacaatgaagaaca

SEQ ID NO: 3403 - DNA, 50 bp, Homo sapiens
cagtaatagctgaacctgttcaaaatgttaataaaggtttcgttgcatgg

SEQ ID NO: 3404 - DNA, 50 bp, Homo sapiens
agggagtggggaggtggtaagaacacctgacaacttctgaatattggaca

SEQ ID NO: 3405 - DNA, 50 bp, Homo sapiens
aaaattagtggattgactccactttgttgtgttgttttcattgttgaaaa

SEQ ID NO: 3406 - DNA, 50 bp, Homo sapiens
aatggaggcacgaacgcaggggccaaatagcaataaatgggttttgtttt

SEQ ID NO: 3407 - DNA, 50 bp, Homo sapiens
tgttttgattgttttgcaaggaagaaagacaatggaataacataccttca

SEQ ID NO: 3408 - DNA, 50 bp, Homo sapiens
tcattgctgtctacaggtttctttcagattatgttcatgggtttgtgtgt

SEQ ID NO: 3409 - DNA, 50 bp, Homo sapiens
gaaaacagaccttgtgctgaggacacgtcaataaaaattataccttcccc

SEQ ID NO: 3410 - DNA, 50 bp, Homo sapiens
gggataccagctgagtctgaattctgctctaaataaagacgactacagag

SEQ ID NO: 3411 - DNA, 50 bp, Homo sapiens
tggctcggataagagatgggacatcattcagtcactagttggatggcaca

SEQ ID NO: 3412 - DNA, 50 bp, Homo sapiens
aacttgatgaaagtattgcagtattgatgccattgtagaatagaactgga

SEQ ID NO: 3413 - DNA, 50 bp, Homo sapiens
tttgtgtgttgggaccaaacagttgtcaataaactttacaagcgagcatc

SEQ ID NO: 3414 - DNA, 50 bp, Homo sapiens; identical to SEQ ID NO: 1675

SEQ ID NO: 3415 - DNA, 50 bp, Homo sapiens
aggtggtcaatgaatgttttgatgaaatgaatgtttttgtataatggcct

SEQ ID NO: 3416 - DNA, 50 bp, Homo sapiens
acgggacaattttaagatgtaataccaatactttagaagtttggtcgtgt

SEQ ID NO: 3417 - DNA, 50 bp, Homo sapiens; identical to SEQ ID NO: 612

SEQ ID NO: 3418 - DNA, 50 bp, Homo sapiens; identical to SEQ ID NO: 612

SEQ ID NO: 3419 - DNA, 50 bp, Homo sapiens
acttttatgtaaaaaagtgcacctttagttttacaagtaaagcaggttgt

SEQ ID NO: 3420 - DNA, 50 bp, Homo sapiens
tcttaataataatgaagacgacttaccctgtggaattgaacacactggtg

SEQ ID NO: 3421 - DNA, 50 bp, Homo sapiens
gctgctgtgtgtatttatgaatattaatgaataaaaactgcttggatggt

SEQ ID NO: 3422 - DNA, 50 bp, Homo sapiens; identical to SEQ ID NO: 812

SEQ ID NO: 3423 - DNA, 50 bp, Homo sapiens
taaatttatttatttatgaaaaaacctcgtgccgaattcttggcctcgag

SEQ ID NO: 3424 - DNA, 50 bp, Homo sapiens
gggtttccgctggctctcccagtatattgactgatgtttggacggtgaaa

SEQ ID NO: 3425 - DNA, 50 bp, Homo sapiens
gtacagttactcatgtcattgtaatgatttcactcctaactgtgacattt

SEQ ID NO: 3426 - DNA, 50 bp, Homo sapiens
actgagttgtcagaaattatgtcaaaatgaaaactgtttgtttcatgaca

SEQ ID NO: 3427 - DNA, 50 bp, Homo sapiens
acctgacttcaccatgtttattccctttgcctacaaccagttaatatctg

SEQ ID NO: 3428 - DNA, 50 bp, Homo sapiens
tcatgcgtgaacaatttaaaaaacgacagaataaggtacaaatgtagtgt

SEQ ID NO: 3429 - DNA, 50 bp, Homo sapiens
cccatcccccctccccacccccatccccaatacagctacgtttgtacatc

SEQ ID NO: 3430 - DNA, 50 bp, Homo sapiens
ccaacaaaattgggatcatccaaactgagtccatctggctaattctaaat

SEQ ID NO: 3431 - DNA, 50 bp, Homo sapiens
tgactggaactgagagtaaattgggaatgtatgaccaatcttagaccctg

SEQ ID NO: 3432 - DNA, 50 bp, Homo sapiens
tgtttaaatgatggtgaatactttcttaacactggtttgtctgcatgtgt

SEQ ID NO: 3433 - DNA, 50 bp, Homo sapiens
acctaaggtcaagctgggagagagaaatgactgagatgaatgtctttact

SEQ ID NO: 3434 - DNA, 50 bp, Homo sapiens
gcttagggaaatttcacagttcattgtggagtgttaaacttagaacatgt

SEQ ID NO: 3435 - DNA, 50 bp, Homo sapiens
tgttacaggtttccaaggtggacttgaacagatggccttatattaccaaa

SEQ ID NO: 3436 - DNA, 50 bp, Homo sapiens
tgttactgctttgccagttctacgttatttacaattattcagctcttgca

SEQ ID NO: 3437 - DNA, 50 bp, Homo sapiens
tttctgtattgcagtgtttataggcttcttgtgtgttaaacttgatttca

SEQ ID NO: 3438 - DNA, 50 bp, Homo sapiens; identical to SEQ ID NO: 860

SEQ ID NO: 3439 - DNA, 50 bp, Homo sapiens
gtttgtgttaccctcctgtaaatggtgtacataatgtattgttggtaatt

SEQ ID NO: 3440 - DNA, 50 bp, Homo sapiens
gctcaccatacggctctaacagattaggggctaaaacgattactgacttt

SEQ ID NO: 3441 - DNA, 50 bp, Homo sapiens
cggctgatgggacaggaattgaagaagagaattgactcgtatgaacagga

SEQ ID NO: 3442 - DNA, 50 bp, Homo sapiens
tggtgctacgaagccatttctcttgatttttagtaaacttttatgacagc

SEQ ID NO: 3443 - DNA, 50 bp, Homo sapiens
tgagaaactgtttgacctggttcgaagaatgttagaatatgatccaactc

SEQ ID NO: 3444 - DNA, 50 bp, Homo sapiens
ggtgggacacgccaagctcttcagtgaagacacgatgttattaaaagcct

SEQ ID NO: 3445 - DNA, 50 bp, Homo sapiens
tgctttgaagctacctggatatttcctatttgaaataaaattgttcggtc

SEQ ID NO: 3446 - DNA, 50 bp, Homo sapiens
atcgccaagaacctggttagaggcataaagaccttttttcaccgttacct

SEQ ID NO: 3447 - DNA, 50 bp, Homo sapiens
tgctgcgacgcacatacatacgtgttgtgtctgtcaataaagtgtaaata

SEQ ID NO: 3448 - DNA, 50 bp, Homo sapiens
tgggaggagataagaagagaaagggccaagtgatccagttctaagtgtca

SEQ ID NO: 3449 - DNA, 50 bp, Homo sapiens
tgcagtagttgactttgctgtatggaaaaataaagtgaaattgccctaat

SEQ ID NO: 3450 - DNA, 50 bp, Homo sapiens
gctaaataaggaatactcatgccaagatcatcgaattgtgcctcctccct

SEQ ID NO: 3451 - DNA, 50 bp, Homo sapiens; identical to SEQ ID NO: 1780

SEQ ID NO: 3452 - DNA, 50 bp, Homo sapiens
ggagtcagtcagtgctcctatatttttcattttttgtcaaagcaagaagt

SEQ ID NO: 3453 - DNA, 50 bp, Homo sapiens
tttgtggccgagtgtaacaaccatataataaatcacctcttccgctgttt

SEQ ID NO: 3454 - DNA, 50 bp, Homo sapiens
ttctacatgaaatgtttagctcttacactctatccttcctagaaaatggt

SEQ ID NO: 3455 - DNA, 50 bp, Homo sapiens
ggacgacagtgaaatctagagtaaaaccaagctggcccaagtgtcctgca

SEQ ID NO: 3456 - DNA, 50 bp, Homo sapiens
tgttttggggtctgtgagagtacatgtattatatacaagcacaacagggc

SEQ ID NO: 3457 - DNA, 50 bp, Homo sapiens
aggaacagttagttctcatctagaatgaaagttccatatatgcattggtg

SEQ ID NO: 3458 - DNA, 50 bp, Homo sapiens
tgtgtgtgtatcccataccccactctggaaggaaccatccagtaaaggtc

SEQ ID NO: 3459 - DNA, 50 bp, Homo sapiens
gtgcaaggggagcacatattggatgtatatgttaccatatgttaggaaat

SEQ ID NO: 3460 - DNA, 50 bp, Homo sapiens; identical to SEQ ID NO: 293

SEQ ID NO: 3461 - DNA, 50 bp, Homo sapiens
acccagtcacctctgtcttcagcaccctcataagtcgtcactaatacaca

SEQ ID NO: 3462 - DNA, 50 bp, Homo sapiens
tgaatcacattgtcagaattttttcctcctcgctgttcaattttgtagtt

SEQ ID NO: 3463 - DNA, 50 bp, Homo sapiens
agatgccttgttgctttgaagaagggagtgatgtcaattctcttgttaca

SEQ ID NO: 3464 - DNA, 50 bp, Homo sapiens; identical to SEQ ID NO: 649

SEQ ID NO: 3465 - DNA, 50 bp, Homo sapiens
aaaagttctctgtagatttctgaagtgcatattcattgatgccaagaaaa

SEQ ID NO: 3466 - DNA, 50 bp, Homo sapiens
ggaggagtttgcatgtctcatgataaccaaatgtaagatgaaaataaaag

SEQ ID NO: 3467 - DNA, 50 bp, Homo sapiens
ttggtgacttagtgattttgtcattttttacatcaacttcatggtcttgt

SEQ ID NO: 3468 - DNA, 50 bp, Homo sapiens
cgcccggcagcccccatccatctgtgtctgtctgttggcctgtatctgtt

SEQ ID NO: 3469 - DNA, 50 bp, Homo sapiens
ggcatcgccaacgcctgcctcgtgccacctcatgcttataataaagccgg

SEQ ID NO: 3470 - DNA, 50 bp, Homo sapiens; identical to SEQ ID NO: 3210

SEQ ID NO: 3471 - DNA, 50 bp, Homo sapiens
gccgtcctcagttacctttcatgaggcttctagccaaagatgataaaggg

SEQ ID NO: 3472 - DNA, 50 bp, Homo sapiens
aggataaaatcattgtctctggaggcaatttggaaattatttctgcttct

SEQ ID NO: 3473 - DNA, 50 bp, Homo sapiens
cgggtgattacaggcaccagtgcagtgatgattgtacttatttgacacat

SEQ ID NO: 3474 - DNA, 50 bp, Homo sapiens
gcctctggtgctttgtcctgtatttggtttaatgtttttgtcctaatctc

SEQ ID NO: 3475 - DNA, 50 bp, Homo sapiens
ttgatgtgaattcagttattgaacttgttacttgtttttgccagaaatgt

SEQ ID NO: 3476 - DNA, 50 bp, Homo sapiens
aagcttcgaactcaaaatcatggaaaggttttaagatttgaggttggttt

SEQ ID NO: 3477 - DNA, 50 bp, Homo sapiens
cccagttagatatcagtgagtttgaataactgaagaaatgttgacaatgt

SEQ ID NO: 3478 - DNA, 50 bp, Homo sapiens
aagtacacctgtcagctgtttcttaccacttcgatggttgtgattaattt

SEQ ID NO: 3479 - DNA, 50 bp, Homo sapiens
tgtttgcttgaacagttgtgtaaatcatacaggattttgtgggtattggt

SEQ ID NO: 3480 - DNA, 50 bp, Homo sapiens
tgaccttctgtgtttttgtttctgacttgaataatttatcaatggtgttg

SEQ ID NO: 3481 - DNA, 50 bp, Homo sapiens
ccagggctgctttgctgtgatgatgattgcatttcaacacatgccagatg

SEQ ID NO: 3482 - DNA, 50 bp, Homo sapiens
gagttaccacaccccatgagggaagctctaaatagccaacacccatctgt

SEQ ID NO: 3483 - DNA, 50 bp, Homo sapiens
ttctatccttgacttagattctggtggagagaagtgagaataggcagccc

SEQ ID NO: 3484 - DNA, 50 bp, Homo sapiens
tcttgctctttctactctgaactaataaagctgttgccaagctggacggc

SEQ ID NO: 3485 - DNA, 50 bp, Homo sapiens
tgcaaacaaatgcataaatgcaaatgtaaagtaaagctgaaattgatctc

SEQ ID NO: 3486 - DNA, 50 bp, Homo sapiens; identical to SEQ ID NO: 1727

SEQ ID NO: 3487 - DNA, 50 bp, Homo sapiens
tgcaatggaatataaatatcacaaagttgtttaactagactgcgtgttgt

SEQ ID NO: 3488 - DNA, 50 bp, Homo sapiens
tttcacctcctcagtcccttgcctaccccagtgagagtctgatcttgttt

SEQ ID NO: 3489 - DNA, 50 bp, Homo sapiens
cgcctctccccgtggaccctgttaatcccaataaaattctgagcaagttc

SEQ ID NO: 3490 - DNA, 50 bp, Homo sapiens
aggattcgctgttgaaacaagttgtccaagcaatgttatattcattttta

SEQ ID NO: 3491 - DNA, 50 bp, Homo sapiens
ggaagggggacaagggtcagtctgtcgggtgggggcagaaatcaaatcag

SEQ ID NO: 3492 - DNA, 50 bp, Homo sapiens; identical to SEQ ID NO: 3491

SEQ ID NO: 3493 - DNA, 50 bp, Homo sapiens
tttttcccagctcgccacagaatggatcatgaagactgacaactgcaaaa

SEQ ID NO: 3494 - DNA, 50 bp, Homo sapiens
aggagtggcctaagaaatgcgtgtttcagtgactagattataaatattct

SEQ ID NO: 3495 - DNA, 50 bp, Homo sapiens
agctgtgaacttcgtaactttgtaaagcaagatataaagcaaatacaaga

SEQ ID NO: 3496 - DNA, 50 bp, Homo sapiens
aggagggatcacctgcactgagaatgaggcagtttgacacagatcacaaa

SEQ ID NO: 3497 - DNA, 50 bp, Homo sapiens
tgttccactaccagccttacttgtttaataaaaatcagtgcaaagagaaa

SEQ ID NO: 3498 - DNA, 50 bp, Homo sapiens
acctcagattttgttacctgtcttttaaaaatgcagattttgtcaaatca

SEQ ID NO: 3499 - DNA, 50 bp, Homo sapiens
ttaacggcttcactggacagttttccttagaaggtagttttgtgtgactg

SEQ ID NO: 3500 - DNA, 50 bp, Homo sapiens
accgtgggtgtgtccaagaagaaataagtctgtaggccttgtctgttaat

SEQ ID NO: 3501 - DNA, 50 bp, Homo sapiens
ccaatggatatttctgtattactagggaggcatttacagtcctctaatgt

SEQ ID NO: 3502 - DNA, 50 bp, Homo sapiens
tagctttagaaaataacagtttgtgaacttacttccctatatttgcagct

SEQ ID NO: 3503 - DNA, 50 bp, Homo sapiens
ctttgtggactagccaaggctgtgagggccagaataaacaactgctcaac

SEQ ID NO: 3504 - DNA, 50 bp, Homo sapiens
gccgagcaatgacccttttcaatttcttatttctgtgttactgaggaccc

SEQ ID NO: 3505 - DNA, 50 bp, Homo sapiens
gaaacatgtggatttgctgtggaatgacaagcttcaaggatttacccagg

SEQ ID NO: 3506 - DNA, 50 bp, Homo sapiens
tttgatctgaaatgtttgagaagacacgaataaagttacttgggcagaaa

SEQ ID NO: 3507 - DNA, 50 bp, Homo sapiens
tcccatcaaaaaggtatcaaatgccttggaagctccctgatcctacaaaa

SEQ ID NO: 3508 - DNA, 50 bp, Homo sapiens
atctgacattattgtaactaccgtgtgatcagtaagattcctgtaagaaa

SEQ ID NO: 3509 - DNA, 50 bp, Homo sapiens
accttgtaccatggaaaacatgaaaagagtcttagaagtaaagaacaaca

SEQ ID NO: 3510 - DNA, 50 bp, Homo sapiens
agcatgtgtctgccatttcatttgtacgcttgttcaaaaccaagtttgtt

SEQ ID NO: 3511 - DNA, 50 bp, Homo sapiens
tgagctgtattaccataagtagaattttaagtaaactggtgaatttgggc

SEQ ID NO: 3512 - DNA, 50 bp, Homo sapiens
gccccattaaagggtgaacttgtaataaattggaatttcaaataaacctc

SEQ ID NO: 3513 - DNA, 50 bp, Homo sapiens; identical to SEQ ID NO: 991

SEQ ID NO: 3514 - DNA, 50 bp, Homo sapiens
aacgtcatgtgcacctttacactgtggttagtgtaataaaacatgttcct

SEQ ID NO: 3515 - DNA, 50 bp, Homo sapiens; identical to SEQ ID NO: 3369

SEQ ID NO: 3516 - DNA, 50 bp, Homo sapiens
gcagccacccactgggagtcttgtttttatttataataaaattgttgggg

SEQ ID NO: 3517 - DNA, 50 bp, Homo sapiens
atccaccaaaaattaggtcatcatagttgaggtatgtgtctgctatttgc

SEQ ID NO: 3518 - DNA, 50 bp, Homo sapiens
ccattggctggaacatggattggggatttgatagaaaaataaaccctgct

SEQ ID NO: 3519 - DNA, 50 bp, Homo sapiens
gttccttactctgtccttgatggaggggagaagggagggcaaagaagtta

SEQ ID NO: 3520 - DNA, 50 bp, Homo sapiens
tggttttcctttggggacgtggttaacggtccagaagaatcccttctaga

SEQ ID NO: 3521 - DNA, 50 bp, Homo sapiens
acccctttcactcttggctttcttatgttgctttcatgaatggaatggaa

SEQ ID NO: 3522 - DNA, 50 bp, Homo sapiens
cccatcctcatcccccacactgggatagatgcttgtttgtaaaaactcac

SEQ ID NO: 3523 - DNA, 50 bp, Homo sapiens
tcaggccgcctagctgcccctttgccaggttaataaagcactgacttgtt

SEQ ID NO: 3524 - DNA, 50 bp, Homo sapiens
aaggattttaaataactgccgacttcaaaagtgttcttaaaacgaaagat

SEQ ID NO: 3525 - DNA, 50 bp, Homo sapiens
cacccaccctccccccaatcagtgttcttatttcagtgacaataaaccat

SEQ ID NO: 3526 - DNA, 50 bp, Homo sapiens
atagctggtgacaaacagatggttgctcagggacaaggtgccttccaatg

SEQ ID NO: 3527 - DNA, 50 bp, Homo sapiens; identical to SEQ ID NO: 922

SEQ ID NO: 3528 - DNA, 50 bp, Homo sapiens; identical to SEQ ID NO: 1047

SEQ ID NO: 3529 - DNA, 50 bp, Homo sapiens; identical to SEQ ID NO: 1104

SEQ ID NO: 3530 - DNA, 50 bp, Homo sapiens
gctgctgtgtgtggtctcagaggctctgcttccttaggttacaaaacaaa

SEQ ID NO: 3531 - DNA, 50 bp, Homo sapiens; identical to SEQ ID NO: 817

SEQ ID NO: 3532 - DNA, 50 bp, Homo sapiens
ccccacaatggtctcttttctccctgctcccttattaaagaactctttct

SEQ ID NO: 3533 - DNA, 50 bp, Homo sapiens
cagtggttcccattgattctccccatatctttttgctctcaggctctggc

SEQ ID NO: 3534 - DNA, 50 bp, Homo sapiens
cttgtatctctaaatatggtgtgatatgaaccagtccattcacattggaa

SEQ ID NO: 3535 - DNA, 50 bp, Homo sapiens
acatagattttctgccaacaaatcctctctgctgttcacattatcctttg

SEQ ID NO: 3536 - DNA, 50 bp, Homo sapiens; identical to SEQ ID NO: 1484

SEQ ID NO: 3537 - DNA, 50 bp, Homo sapiens
ttagaaccaaagttattcttaataaaaatcaccacatgcttggaccatgc

SEQ ID NO: 3538 - DNA, 50 bp, Homo sapiens
gctcttacacttcgtctttaatgttctttttggagttaggacctctcagt

SEQ ID NO: 3539 - DNA, 50 bp, Homo sapiens
accttgacatgggttgtctaataaaactcggacccttcttgtgaaatcaa

SEQ ID NO: 3540 - DNA, 50 bp, Homo sapiens
atcccagtgcacagtgagttgtatatcacaaataggaggccacttcagga

SEQ ID NO: 3541 - DNA, 50 bp, Homo sapiens
gaagctgctaggggaaggactggcctggctccagaatgttgttgcctttt

SEQ ID NO: 3542 - DNA, 50 bp, Homo sapiens
gggaaggaaaaggggtgtggcagctgggagcgtttatttatgttctttct

SEQ ID NO: 3543 - DNA, 50 bp, Homo sapiens
gagtggtgttcccagtgtggctcccagagctttgaccagattgtgatccc

SEQ ID NO: 3544 - DNA, 50 bp, Homo sapiens
ctttgcatttagggacacagcccggagccgcagaaggtcagcagggagca

SEQ ID NO: 3545 - DNA, 50 bp, Homo sapiens
cattgcctactttaacacctgtcagagaaacgtgatatggggtaaggagg

SEQ ID NO: 3546 - DNA, 50 bp, Homo sapiens
gcaatctgggagcagcacattgttgatggagtccaagtgagcacatttca

SEQ ID NO: 3547 - DNA, 50 bp, Homo sapiens
ctctcctggactgttgcagttgggtgtggctgatttgaaattgtgcttca

SEQ ID NO: 3548 - DNA, 50 bp, Homo sapiens
taacaagaattgcattgaggaaacaaggctccacagggccaatcttctgg

SEQ ID NO: 3549 - DNA, 50 bp, Homo sapiens
aagaagttacatcttcaatgtccagggatgatcgtttgaagagaacctct

SEQ ID NO: 3550 - DNA, 50 bp, Homo sapiens
aaaacattgccagaccatttagtcctcttggaagggcctctccggtgggg

SEQ ID NO: 3551 - DNA, 50 bp, Homo sapiens
agggataataaggttagctgttaaccaagcaactgagcttttaaccaaag

SEQ ID NO: 3552 - DNA, 50 bp, Homo sapiens
caagacactgtggacttggtcaccagctcctcccttgttctctaagttcc

SEQ ID NO: 3553 - DNA, 50 bp, Homo sapiens
tctttgacggggttttccttgctcctgccaggattaaaagtccatgagtt

SEQ ID NO: 3554 - DNA, 50 bp, Homo sapiens
cttaaagtatatgttttcaaattgccattgctactattgcttgtcggtgt

SEQ ID NO: 3555 - DNA, 50 bp, Homo sapiens
ctcctgtcaccggccttgtgacattcactcagagaagaccacaccaagga

SEQ ID NO: 3556 - DNA, 50 bp, Homo sapiens
gtcggactatgtaattgtaactatacctctggttcccattaaaagtgacc

SEQ ID NO: 3557 - DNA, 50 bp, Homo sapiens
gctagtgtttgaatatgctctcttgttgctctaattctgtgcctccgtgc

SEQ ID NO: 3558 - DNA, 50 bp, Homo sapiens
agaggaacttgaaaccttgaaagacatttgttctcccaaaactgattact

SEQ ID NO: 3559 - DNA, 50 bp, Homo sapiens
actgggatattgcccacatgatcagtggctttgaatgaaatacagatgca

SEQ ID NO: 3560 - DNA, 50 bp, Homo sapiens; identical to SEQ ID NO: 2932

SEQ ID NO: 3561 - DNA, 50 bp, Homo sapiens
tttcttaggacaccatttgggctagtttctgtgtaagtgtaaatactaca

SEQ ID NO: 3562 - DNA, 50 bp, Homo sapiens; identical to SEQ ID NO: 2488

SEQ ID NO: 3563 - DNA, 50 bp, Homo sapiens
ttaacaccccacacccacccctcagttgggacaaataaaggattctcatg

SEQ ID NO: 3564 - DNA, 50 bp, Homo sapiens
caagccgccacatgcccacaacctcaccagagggagaattatgtttctaa

SEQ ID NO: 3565 - DNA, 50 bp, Homo sapiens
gtgtattgatccaagtagtcaaagtgtcttaaagggcacctatttgtcct

SEQ ID NO: 3566 - DNA, 50 bp, Homo sapiens
agtgctttccaaatgtgattgttctgggtgatgggacatatgggcagttg

SEQ ID NO: 3567 - DNA, 50 bp, Homo sapiens
cgggggaataggaggaaaaacatggcatggaacaaaccaacataaaaggt

SEQ ID NO: 3568 - DNA, 50 bp, Homo sapiens
actaattctgctctttggacaagtgcctgacatctgcttcattgggtttt

SEQ ID NO: 3569 - DNA, 50 bp, Homo sapiens
aggaataaagttaagtatttcccacttggaaattgtaccactcctggggt

SEQ ID NO: 3570 - DNA, 50 bp, Homo sapiens; identical to SEQ ID NO: 2144

SEQ ID NO: 3571 - DNA, 50 bp, Homo sapiens
gtctggtaagccgatgctaatggcagaagcaatagaagtccaaggcacta

SEQ ID NO: 3572 - DNA, 50 bp, Homo sapiens; identical to SEQ ID NO: 3416

SEQ ID NO: 3573 - DNA, 50 bp, Homo sapiens
ctctcagttcccaagatggccccacattcccattgttttccccaagagaa

SEQ ID NO: 3574 - DNA, 50 bp, Homo sapiens
ggttgttgtattgtaccagtgaaatgccaaatttgaaaggcctgtactgc

SEQ ID NO: 3575 - DNA, 50 bp, Homo sapiens
ttgtttgccatctgttgatcaggaactacttcagctacttgcatttgatt

SEQ ID NO: 3576 - DNA, 50 bp, Homo sapiens; identical to SEQ ID NO: 2966

SEQ ID NO: 3577 - DNA, 50 bp, Homo sapiens
acagagagcacccaggaggtacacatactaaagtgacacaaagagaatga

SEQ ID NO: 3578 - DNA, 50 bp, Homo sapiens; identical to SEQ ID NO: 1887

SEQ ID NO: 3579 - DNA, 50 bp, Homo sapiens
agcatgttgtttaatttctttttaaaaatcactgttgggctttgaaagca

SEQ ID NO: 3580 - DNA, 50 bp, Homo sapiens
gctgacaaaacctgggaatttgggttgtgtatgcgaatgtttcagtgcct

SEQ ID NO: 3581 - DNA, 50 bp, Homo sapiens
tcactttccaaatgcctgttttgtgctttacaataaatgatatgaaacct

SEQ ID NO: 3582 - DNA, 50 bp, Homo sapiens
tttatgcgtatttaagccttggaaacacagggactatcttgtggattggg

SEQ ID NO: 3583 - DNA, 50 bp, Homo sapiens; identical to SEQ ID NO: 2782

SEQ ID NO: 3584 - DNA, 50 bp, Homo sapiens
acatccagtgtctccaaaattgtttccttgtactgatataaacacttcca

SEQ ID NO: 3585 - DNA, 50 bp, Homo sapiens
ggtacagttggagcactatatgtactctctggactactttggacagaagt

SEQ ID NO: 3586 - DNA, 50 bp, Homo sapiens
aaaatcacctcaacagccctgtgaagtgacctcagtgagatatttggatc

SEQ ID NO: 3587 - DNA, 50 bp, Homo sapiens
ttaaagtgcaccttccaaaatgtctcccataagtaggtaagaccaacctg

SEQ ID NO: 3588 - DNA, 50 bp, Homo sapiens
aatgatgagtgtgtggctacatacaaaggagttccctttgaggtgaaagg

SEQ ID NO: 3589 - DNA, 50 bp, Homo sapiens; identical to SEQ ID NO: 2872

SEQ ID NO: 3590 - DNA, 50 bp, Homo sapiens; identical to SEQ ID NO: 2749

SEQ ID NO: 3591 - DNA, 50 bp, Homo sapiens
ttgtccacaagtaaaaggaaatcctcctccagggagtctcagcttcaccc

SEQ ID NO: 3592 - DNA, 50 bp, Homo sapiens
cattgctctttagtgtgtgttaacctgtggtttgaaagaaatgctcttgt

SEQ ID NO: 3593 - DNA, 50 bp, Homo sapiens
gtctggcttaactatttttgaaaatataactgtttcccctctctgctgct

SEQ ID NO: 3594 - DNA, 50 bp, Homo sapiens
aaaagcaattacccttaaaactgtactctggcctacttttctattttgca

SEQ ID NO: 3595 - DNA, 50 bp, Homo sapiens
ggctctcagtgtgccatagaggacagcaactggtgattgtttcagagaaa

SEQ ID NO: 3596 - DNA, 50 bp, Homo sapiens
aaactgtttctttggtgtcctttacattgaaataaattgtgtttgtgcct

SEQ ID NO: 3597 - DNA, 50 bp, Homo sapiens; identical to SEQ ID NO: 2640

SEQ ID NO: 3598 - DNA, 50 bp, Homo sapiens
agagagggaacatcaaatgctggcactatatacatacgatcagcctgatt

SEQ ID NO: 3599 - DNA, 50 bp, Homo sapiens
gtcttccgagaaacttttctgatcagtttgcgagttttgatgagttttgt

SEQ ID NO: 3600 - DNA, 50 bp, Homo sapiens
gctgctgttgctgctttgtgatgacgtgagatcaataagaagaacctagt

SEQ ID NO: 3601 - DNA, 50 bp, Homo sapiens
aggactgaactgaacccctccccatgaacacaagggttttatcctttcct

SEQ ID NO: 3602 - DNA, 50 bp, Homo sapiens
gatgtggtaactgttaaattgctgtgtatctgatagctctttggcagtct

SEQ ID NO: 3603 - DNA, 50 bp, Homo sapiens
gatcaaaagggctatgggaagggcagaccccgccaatgatttctcttcac

SEQ ID NO: 3604 - DNA, 50 bp, Homo sapiens
gaacagctttgtgctccggctttccctcagggaacagcagagagcagttg

SEQ ID NO: 3605 - DNA, 50 bp, Homo sapiens
tccagggaccaacattaacacaaccaatcaacacatcatgttacagaact

SEQ ID NO: 3606 - DNA, 50 bp, Homo sapiens
tattaaaggcttttggcagcaaagtgtcagtgttggcagcgaagtgtcag

SEQ ID NO: 3607 - DNA, 50 bp, Homo sapiens
ttcacaagatgctttgaaggttctgattttcaactgatcaaactaatgca

SEQ ID NO: 3608 - DNA, 50 bp, Homo sapiens; identical to SEQ ID NO: 1944

SEQ ID NO: 3609 - DNA, 50 bp, Homo sapiens; identical to SEQ ID NO: 2738

SEQ ID NO: 3610 - DNA, 50 bp, Homo sapiens
ctgtgtctggcaccacccacacatccatgtctccctcacaacccaggagg

SEQ ID NO: 3611 - DNA, 50 bp, Homo sapiens
catgtatgtaggtgcctgggagtgtgtgtggtccttgctctggccctttc

SEQ ID NO: 3612 - DNA, 50 bp, Homo sapiens; identical to SEQ ID NO: 2263

SEQ ID NO: 3613 - DNA, 50 bp, Homo sapiens
tcttcggaaagaagaaggtgggaggatgtgaattgttagtttctgagttt

SEQ ID NO: 3614 - DNA, 50 bp, Homo sapiens
atcaagcctctgtgcctcagtttctctctcaggataaagagtgaatagag

SEQ ID NO: 3615 - DNA, 50 bp, Homo sapiens
gcgatagaggaaatctactccctatcttgggtccttgaactacagcctgc

SEQ ID NO: 3616 - DNA, 50 bp, Homo sapiens
ctagggagccgcaccttgtcatgtaccatcaataaagtaccctgtgctca

SEQ ID NO: 3617 - DNA, 50 bp, Homo sapiens
tttctccccctagtttgtgagaaacatctcaataaagtgctttccaaaaa

SEQ ID NO: 3618 - DNA, 50 bp, Homo sapiens; identical to SEQ ID NO: 3507

SEQ ID NO: 3619 - DNA, 50 bp, Homo sapiens
tgccaaaagtttgccatgtgccttaaacatattactatatattttcccct

SEQ ID NO: 3620 - DNA, 50 bp, Homo sapiens; identical to SEQ ID NO: 2975

SEQ ID NO: 3621 - DNA, 50 bp, Homo sapiens
ttaccaagaaggacttaagggagtaaggggcgcagattagcattgctcaa

SEQ ID NO: 3622 - DNA, 50 bp, Homo sapiens
gatatgcacatcaaagcctttaccagtatcttcctgtattccgtatcaga

SEQ ID NO: 3623 - DNA, 50 bp, Homo sapiens
ctctgaggcgtgaggactcgcagtcaggggcagctgaccatggaagattg

SEQ ID NO: 3624 - DNA, 50 bp, Homo sapiens
cctctcttcctccctggaatcttgtaaaggtcctggcaaagatgatcagt

SEQ ID NO: 3625 - DNA, 50 bp, Homo sapiens
gcctcctggtctcttcaccactgtagttctctcatttccaaaccatcagc

SEQ ID NO: 3626 - DNA, 50 bp, Homo sapiens
ttttccttctaacacttgtatttggaggctcttctgtgattttgagaagt

SEQ ID NO: 3627 - DNA, 50 bp, Homo sapiens; identical to SEQ ID NO: 2578

SEQ ID NO: 3628 - DNA, 50 bp, Homo sapiens
ggacatccactagagatgggtttgaggattttccaagcgtgtaataatga

SEQ ID NO: 3629 - DNA, 50 bp, Homo sapiens
ttgcacgcagagcctttaagtgactaaggaacaacatagatagtgagcat

SEQ ID NO: 3630 - DNA, 50 bp, Homo sapiens
actttaatctgatcttgtgtcttagagaagcccccatacctggtagagca

SEQ ID NO: 3631 - DNA, 50 bp, Homo sapiens
tgtaggaaaggatgcttcacaaactgaggtagataatgctatgctgtcgt

SEQ ID NO: 3632 - DNA, 50 bp, Homo sapiens; identical to SEQ ID NO: 3631

SEQ ID NO: 3633 - DNA, 50 bp, Homo sapiens
ctggggagaggctgaggacaaatacctgctgtcactccagaggacatttt

SEQ ID NO: 3634 - DNA, 50 bp, Homo sapiens
cattacttgtgagctgctgaacaaacaagtcaaggtgagcccggacatgg

SEQ ID NO: 3635 - DNA, 50 bp, Homo sapiens; identical to SEQ ID NO: 2547

SEQ ID NO: 3636 - DNA, 50 bp, Homo sapiens
gaaacttgctacagacttacccgtaatatttgtcaagatcatagctgact

SEQ ID NO: 3637 - DNA, 50 bp, Homo sapiens; identical to SEQ ID NO: 47

SEQ ID NO: 3638 - DNA, 50 bp, Homo sapiens
tgctaaatatgttattgtggaaagatgaatgcaatagtaggactgctgac

SEQ ID NO: 3639 - DNA, 50 bp, Homo sapiens; identical to SEQ ID NO: 2914

SEQ ID NO: 3640 - DNA, 50 bp, Homo sapiens
tcctcttttctttcaagaactatatataaatgacctgttttcacgcggcc

SEQ ID NO: 3641 - DNA, 50 bp, Homo sapiens
agctgcaaagtgttttgtaccagtgaatttttgcaataatgcagtatggt

SEQ ID NO: 3642 - DNA, 50 bp, Homo sapiens; identical to SEQ ID NO: 2661

SEQ ID NO: 3643 - DNA, 50 bp, Homo sapiens
acatagtgaaagtttataagaggatgaagtgatatggtgagcagcggact

SEQ ID NO: 3644 - DNA, 50 bp, Homo sapiens
aacagcctttctggctgaccacatggttaaatgcataccttcccagtact

SEQ ID NO: 3645 - DNA, 50 bp, Homo sapiens
tgtgcctcacctggacttgtccaattaatgaagttgattcatattgcatc

SEQ ID NO: 3646 - DNA, 50 bp, Homo sapiens
ctatagatgaagacataaaagacactggtaaacaccaatgtaaaagggcc

SEQ ID NO: 3647 - DNA, 50 bp, Homo sapiens; identical to SEQ ID NO: 2915

SEQ ID NO: 3648 - DNA, 50 bp, Homo sapiens; identical to SEQ ID NO: 2750

SEQ ID NO: 3649 - DNA, 50 bp, Homo sapiens
gattcttgctgtagcgtggatagctgtgattggtgagtcaaccgtctgtg

SEQ ID NO: 3650 - DNA, 50 bp, Homo sapiens
tgggcattttaaagccatctcaagaggcatcttctacatgttttgtacgc

SEQ ID NO: 3651 - DNA, 50 bp, Homo sapiens
aagtcagggaccacttgctgaagcacgaagagcccttgtggcaatgttaa

SEQ ID NO: 3652 - DNA, 50 bp, Homo sapiens
gactgctggaagatgatctttctgcactgagactgtggagtttggggaag

SEQ ID NO: 3653 - DNA, 50 bp, Homo sapiens; identical to SEQ ID NO: 2117

SEQ ID NO: 3654 - DNA, 50 bp, Homo sapiens
aattccagctgagcgccggtcgctaccattaccgttggtcttggtgtcaa

SEQ ID NO: 3655 - DNA, 50 bp, Homo sapiens
ccccaaccctcaaattaaaactagaactatagatccacatgaacgcacgc

SEQ ID NO: 3656 - DNA, 50 bp, Homo sapiens
agcttttgaaataaaatttaaaaaccccaagcctgggtgagtgtgggaaa

SEQ ID NO: 3657 - DNA, 50 bp, Homo sapiens; identical to SEQ ID NO: 2700

SEQ ID NO: 3658 - DNA, 50 bp, Homo sapiens; identical to SEQ ID NO: 2844

SEQ ID NO: 3659 - DNA, 50 bp, Homo sapiens; identical to SEQ ID NO: 2981

SEQ ID NO: 3660 - DNA, 50 bp, Homo sapiens; identical to SEQ ID NO: 2511

SEQ ID NO: 3661 - DNA, 50 bp, Homo sapiens
gaattttcagtttgtgcttacattttctaacattggatgtttgctttggc

SEQ ID NO: 3662 - DNA, 50 bp, Homo sapiens
tatgactttaagagcccacattaggttttatgattcatttgccaggtttt

SEQ ID NO: 3663 - DNA, 50 bp, Homo sapiens
ggcgtgccgttgagggggaaaacgaagcccagtatttgctactgtttttc

SEQ ID NO: 3664 - DNA, 50 bp, Homo sapiens
ctcttgggcataaaatctcagaggaagctacttaggacatcatcttggcc

SEQ ID NO: 3665 - DNA, 50 bp, Homo sapiens
tctacagtagcctgtgctgaactgatctcttaaataaacttgcttctggt

SEQ ID NO: 3666 - DNA, 50 bp, Homo sapiens
ttctcaagtttgatactgagttgactgttcccttatccctcaccgttccc

SEQ ID NO: 3667 - DNA, 50 bp, Homo sapiens
agacttttccaaccctcatcaccaacgtctgtgccattttgtattttact

SEQ ID NO: 3668 - DNA, 50 bp, Homo sapiens
ccagcggcatctttccttgtcgaatgatactgtaatgaccttccaaagtg

SEQ ID NO: 3669 - DNA, 50 bp, Homo sapiens; identical to SEQ ID NO: 163

SEQ ID NO: 3670 - DNA, 50 bp, Homo sapiens
tgtgggttgagaccagcactctgtgaaaccttgaaatgagaagtaaaggc

SEQ ID NO: 3671 - DNA, 50 bp, Homo sapiens
tgaatacaaagaaccaagaaaaaggaatgaagactcgcaatttcacgaca

SEQ ID NO: 3672 - DNA, 50 bp, Homo sapiens
ctgaatttggttttgggaggtgaggcttcccaaccacggaagactacttt

SEQ ID NO: 3673 - DNA, 50 bp, Homo sapiens; identical to SEQ ID NO: 3039

SEQ ID NO: 3674 - DNA, 50 bp, Homo sapiens
gacgccttacaaatgatggaggattccaaagagtttttgtttatttgggt

SEQ ID NO: 3675 - DNA, 50 bp, Homo sapiens; identical to SEQ ID NO: 2992

SEQ ID NO: 3676 - DNA, 50 bp, Homo sapiens; identical to SEQ ID NO: 123

SEQ ID NO: 3677 - DNA, 50 bp, Homo sapiens
cagctctgggaaatagaagactagggttgtttcttaaatttagctcatgt

SEQ ID NO: 3678 - DNA, 50 bp, Homo sapiens
tgacttatgagctgtgactcaactgcttcattaaacattctgcattgggt

SEQ ID NO: 3679 - DNA, 50 bp, Homo sapiens
acactgagatagtcagttgtgtgtgactctaataaacggagcctaccttt

SEQ ID NO: 3680 - DNA, 50 bp, Homo sapiens; identical to SEQ ID NO: 3153

SEQ ID NO: 3681 - DNA, 50 bp, Homo sapiens
ggatgataacaccctatgcccattgtcctgatctgaaaattcttggaaat

SEQ ID NO: 3682 - DNA, 50 bp, Homo sapiens; identical to SEQ ID NO: 117

SEQ ID NO: 3683 - DNA, 50 bp, Homo sapiens
aaaagcatttaagttgaatgcgaccaaccttgtgctcttttcattctgga

SEQ ID NO: 3684 - DNA, 50 bp, Homo sapiens
ccttgagaaacacccatctccactcctagacaaaccaatgaacattagtc

SEQ ID NO: 3685 - DNA, 50 bp, Homo sapiens
tcttaaggtgtggcagagacagggtatttgggatatacttttcagactcc

SEQ ID NO: 3686 - DNA, 50 bp, Homo sapiens
aacaataaaatatggctagactggcctctggttgcctaaacagagcatca

SEQ ID NO: 3687 - DNA, 50 bp, Homo sapiens
cttaactgagggcttgtcctggttataaatgtctgggtgggggtgggcac

SEQ ID NO: 3688 - DNA, 50 bp, Homo sapiens
aactgtgaggcaaataaaatgcttctcaaactgtgtggctcttatggggt

SEQ ID NO: 3689 - DNA, 50 bp, Homo sapiens
gtggctaagtcattgcaggaacggggctgtgttctctgctgggacaaaac

SEQ ID NO: 3690 - DNA, 50 bp, Homo sapiens
attgcgactgtatggagaagaactgtttgtcattcagtgccgtgggatat

SEQ ID NO: 3691 - DNA, 50 bp, Homo sapiens
tttatagaacaattcctttctcttctcttgaatgtggcagtcattactgc

SEQ ID NO: 3692 - DNA, 50 bp, Homo sapiens
ttgattagagcaatgggaagcatactgtggcctaccagcatctggaagtg

SEQ ID NO: 3693 - DNA, 50 bp, Homo sapiens
tcaattgaggccccttccctaagattacaacattgataacctgtcctttt

SEQ ID NO: 3694 - DNA, 50 bp, Homo sapiens
cagccctccgtcgctttttataaaactttgtgtgagaagaatatattgat

SEQ ID NO: 3695 - DNA, 50 bp, Homo sapiens
acttcagatccttttgtgtttaaataaaggaaaagctgcacatccaaaaa

SEQ ID NO: 3696 - DNA, 50 bp, Homo sapiens
agcctacctcctaccccagctgtctgttgagagcagtgctgaccccagca

SEQ ID NO: 3697 - DNA, 50 bp, Homo sapiens
gaagagctgctctcacctctctgcatcccaatagatatccccctatgtgc

SEQ ID NO: 3698 - DNA, 50 bp, Homo sapiens; identical to SEQ ID NO: 1921

SEQ ID NO: 3699 - DNA, 50 bp, Homo sapiens
aaatacaaacattctaattaaaggctttgcaacacatgccttgtctgttt

SEQ ID NO: 3700 - DNA, 50 bp, Homo sapiens
gccattaccaactgtaccttcccttcttgctcagccaataaatatatcct

SEQ ID NO: 3701 - DNA, 50 bp, Homo sapiens; identical to SEQ ID NO: 1986

SEQ ID NO: 3702 - DNA, 50 bp, Homo sapiens; identical to SEQ ID NO: 1875

SEQ ID NO: 3703 - DNA, 50 bp, Homo sapiens
ctggggaggaggtccagggaggaggaggaaagttctcaagttcgtctgac

SEQ ID NO: 3704 - DNA, 50 bp, Homo sapiens
aactaacagtcacgccgtgggatgtctctgtccacattaaactaacagca

SEQ ID NO: 3705 - DNA, 50 bp, Homo sapiens; identical to SEQ ID NO: 2151

SEQ ID NO: 3706 - DNA, 50 bp, Homo sapiens
tttgtctatattctgctcccagcctgccaggccaggaggaaataaacatg

SEQ ID NO: 3707 - DNA, 50 bp, Homo sapiens
ttcctctttggccacaagaataagcagcaaataaacaactatggctgttg

SEQ ID NO: 3708 - DNA, 50 bp, Homo sapiens; identical to SEQ ID NO: 3126

SEQ ID NO: 3709 - DNA, 50 bp, Homo sapiens
gcagtttgaatatcctttgtttcagagccagatcatttcttggaaagtgt

SEQ ID NO: 3710 - DNA, 50 bp, Homo sapiens
ccctggttgacttgactcatgcttgtttcactttcacatggaatttccca

SEQ ID NO: 3711 - DNA, 50 bp, Homo sapiens; identical to SEQ ID NO: 2005

SEQ ID NO: 3712 - DNA, 50 bp, Homo sapiens
cacaaggtaaagaaactcaattcccctgcttggagcccagcaaacacaat

SEQ ID NO: 3713 - DNA, 50 bp, Homo sapiens
tgtggaggaaactaaacattcccttgatggtctcaagctatgatcagaag

SEQ ID NO: 3714 - DNA, 50 bp, Homo sapiens
ggaggagaccagtcccccacccagccgtaccagaaataaaggcttctgtg

SEQ ID NO: 3715 - DNA, 50 bp, Homo sapiens; identical to SEQ ID NO: 243

SEQ ID NO: 3716 - DNA, 50 bp, Homo sapiens
cgctgttaggccggaattaaagtggctttttgaggtttggtttttcacaa

SEQ ID NO: 3717 - DNA, 50 bp, Homo sapiens
ggggtttatgtcctaactgctttgtatgctgttttataaagggatagaag

SEQ ID NO: 3718 - DNA, 50 bp, Homo sapiens
acaccaacctgcttccactttattcttgtttacacattctcctgctccca

SEQ ID NO: 3719 - DNA, 50 bp, Homo sapiens
aagatgtttgtggaaatgttcatttgtatctggatctctgttatgtgcca

SEQ ID NO: 3720 - DNA, 50 bp, Homo sapiens; identical to SEQ ID NO: 3482

SEQ ID NO: 3721 - DNA, 50 bp, Homo sapiens; identical to SEQ ID NO: 2348

SEQ ID NO: 3722 - DNA, 50 bp, Homo sapiens; identical to SEQ ID NO: 1983

SEQ ID NO: 3723 - DNA, 50 bp, Homo sapiens
tcgaatcattgaagatccgagtgtgatttgaattctgtgatattttcaca

SEQ ID NO: 3724 - DNA, 50 bp, Homo sapiens
atatccaatattcgctgtgtcagcatagaagtaacttacttaggtgtggg

SEQ ID NO: 3725 - DNA, 50 bp, Homo sapiens; identical to SEQ ID NO: 1980

SEQ ID NO: 3726 - DNA, 50 bp, Homo sapiens; identical to SEQ ID NO: 2712

SEQ ID NO: 3727 - DNA, 50 bp, Homo sapiens
tctccatgttgtcaaaatcatgccgtttatagctattttcacctcagtgg

SEQ ID NO: 3728 - DNA, 50 bp, Homo sapiens
gccccgttttggggacgtgaacgttttaataatttttgctgaattcttta

SEQ ID NO: 3729 - DNA, 50 bp, Homo sapiens
aggtgggcacaagtattacacatcagaaaatcctgacaaaagggacacat

SEQ ID NO: 3730 - DNA, 50 bp, Homo sapiens
gttcaacaacaccagaactgtgtgtctcatggtatgtaactcttaaagca

SEQ ID NO: 3731 - DNA, 50 bp, Homo sapiens; identical to SEQ ID NO: 2480

SEQ ID NO: 3732 - DNA, 50 bp, Homo sapiens
aaagctgttcaaatactcgagcccagtcttgtggatggaaatgtagtgct

SEQ ID NO: 3733 - DNA, 50 bp, Homo sapiens
cttaagtctgacggacctgtcctgtccaggccagtgcccagggaaggtgt

SEQ ID NO: 3734 - DNA, 50 bp, Homo sapiens
tttctaaccctgacacggactgtgcatactttccctcatccatgctgtgc

SEQ ID NO: 3735 - DNA, 50 bp, Homo sapiens
cagcagctgcctgcttttctgtgatgtatgtatcctgttgacttttccag

SEQ ID NO: 3736 - DNA, 50 bp, Homo sapiens; identical to SEQ ID NO: 2756

SEQ ID NO: 3737 - DNA, 50 bp, Homo sapiens; identical to SEQ ID NO: 113

SEQ ID NO: 3738 - DNA, 50 bp, Homo sapiens
acccatttctactttttgcaccttattttctctgttcctgagcccccaca

SEQ ID NO: 3739 - DNA, 50 bp, Homo sapiens; identical to SEQ ID NO: 2362

SEQ ID NO: 3740 - DNA, 50 bp, Homo sapiens
ggcccagcattgctggttctatttaatggacatgagataatgttagaggt

SEQ ID NO: 3741 - DNA, 50 bp, Homo sapiens
tgaatataatatatttgtgtatttaacagggaggggaagagggggcgatc

SEQ ID NO: 3742 - DNA, 50 bp, Homo sapiens
tggcactttaacattgctttcacctatattttgtgtactttgttacttgc

SEQ ID NO: 3743 - DNA, 50 bp, Homo sapiens
agtaaatgtacagtgatttgaaatacaataatgaaggcaatgcatggcct

SEQ ID NO: 3744 - DNA, 50 bp, Homo sapiens
cttaatgtgacctagcaataggcatagctacgtggcactatattctggcc

SEQ ID NO: 3745 - DNA, 50 bp, Homo sapiens
aggagcacctcacagatgccaacctcaacctgaccgtggacgagggtgtc

SEQ ID NO: 3746 - DNA, 50 bp, Homo sapiens
ccacgacttctgcccattctctccagtgtgtgtaacagggtcacaagaat

SEQ ID NO: 3747 - DNA, 50 bp, Homo sapiens
ggcccaaacctatttgtaaccaaagagctgggagcagcacaaggacccag

SEQ ID NO: 3748 - DNA, 50 bp, Homo sapiens
gcgagcaagcattttgaacacatggatttccttgaagcaggctgacaaga

SEQ ID NO: 3749 - DNA, 50 bp, Homo sapiens
tcggatgggctgtttagatgttatataatccacaaaaggttcattgagct

SEQ ID NO: 3750 - DNA, 50 bp, Homo sapiens; identical to SEQ ID NO: 2285

SEQ ID NO: 3751 - DNA, 50 bp, Homo sapiens
aaaatgaagtcacacaggacaattattcttatgcctaagttaacagtgga

SEQ ID NO: 3752 - DNA, 50 bp, Homo sapiens
gccttgtttaatggtagttttacagtgtttctggcttagaacaaaggggc

SEQ ID NO: 3753 - DNA, 50 bp, Homo sapiens; identical to SEQ ID NO: 3034

SEQ ID NO: 3754 - DNA, 50 bp, Homo sapiens; identical to SEQ ID NO: 2199

SEQ ID NO: 3755 - DNA, 50 bp, Homo sapiens; identical to SEQ ID NO: 3388

SEQ ID NO: 3756 - DNA, 50 bp, Homo sapiens
tggtataagaaatgactttgaaccactttgcaattgtagattcccaacaa

SEQ ID NO: 3757 - DNA, 50 bp, Homo sapiens
cccctgctactttgaaaccagaaaataatgactggccattcgttacatct

SEQ ID NO: 3758 - DNA, 50 bp, Homo sapiens; identical to SEQ ID NO: 2508

SEQ ID NO: 3759 - DNA, 50 bp, Homo sapiens
aaaagccttgtgaaaatgttatgccctatgtaacagcagagtaacataaa

SEQ ID NO: 3760 - DNA, 50 bp, Homo sapiens
ccaccacgggagactagagctgcaggatcccgggggaggggtctctcctc

SEQ ID NO: 3761 - DNA, 50 bp, Homo sapiens
cagtggaagtcccacagaagctacagctgccaggtcacgcatgaagggag

SEQ ID NO: 3762 - DNA, 50 bp, Homo sapiens
cccacactgctttgctgtgtatacgcttgttgccctgaaataaatatgca

SEQ ID NO: 3763 - DNA, 50 bp, Homo sapiens; identical to SEQ ID NO: 3762

SEQ ID NO: 3764 - DNA, 50 bp, Homo sapiens; identical to SEQ ID NO: 1425

SEQ ID NO: 3765 - DNA, 50 bp, Homo sapiens
agagaccagttttctctggaagtttgtttaaatgacagaagcgtatatga

SEQ ID NO: 3766 - DNA, 50 bp, Homo sapiens
cgcccctgccacctccctgacccgtctaatatataaatatagagatgtgt

SEQ ID NO: 3767 - DNA, 50 bp, Homo sapiens
gccagtcagatgtttctcatccttcttgctctgcctttgagttgttccgt

SEQ ID NO: 3768 - DNA, 50 bp, Homo sapiens
aaatactgatgttcctagtgaaagaggcagcttgaaactgagatgtgaac

SEQ ID NO: 3769 - DNA, 50 bp, Homo sapiens
agaagctgcactaggccccgagtccccatgtgtctccttgaattgatgag

SEQ ID NO: 3770 - DNA, 50 bp, Homo sapiens; identical to SEQ ID NO: 2177

SEQ ID NO: 3771 - DNA, 50 bp, Homo sapiens
aaattttatttccagctcctgttccttggaaaatctccattgtatgtgca

SEQ ID NO: 3772 - DNA, 50 bp, Homo sapiens
cctgaaacagctgccaccatcactcgcaagagaatcccctccatctttgg

SEQ ID NO: 3773 - DNA, 50 bp, Homo sapiens
ttctgtgtgtatggtagcacagcaaacttgtaggaattagtatcaatagt

SEQ ID NO: 3774 - DNA, 50 bp, Homo sapiens; identical to SEQ ID NO: 2106

SEQ ID NO: 3775 - DNA, 50 bp, Homo sapiens
gatctcctcttagggtagaagaagtctctgggacatccctggggtgtgtg

SEQ ID NO: 3776 - DNA, 50 bp, Homo sapiens
ggctgccgcaataaaacccagatttctttggtgcgaatgccttacgcatg

SEQ ID NO: 3777 - DNA, 50 bp, Homo sapiens
tcatcatctggatttaggaattgctcttgtcatacccccaagtttctaag

SEQ ID NO: 3778 - DNA, 50 bp, Homo sapiens
tgcccaccactgaaagagtgactttgacaagatgtttctacctcttccca

SEQ ID NO: 3779 - DNA, 50 bp, Homo sapiens
tttgatcaggattcagatgtggacatcttcccctcagacttccctactga

SEQ ID NO: 3780 - DNA, 50 bp, Homo sapiens; identical to SEQ ID NO: 180

SEQ ID NO: 3781 - DNA, 50 bp, Homo sapiens
cggattgttgctgttaatgctgctcattttagcactgtggaagattggat

SEQ ID NO: 3782 - DNA, 50 bp, Homo sapiens
tagagattgtgaagaagaatttcgatctccgccctggggtcattgtcagg

SEQ ID NO: 3783 - DNA, 50 bp, Homo sapiens; identical to SEQ ID NO: 2036

SEQ ID NO: 3784 - DNA, 50 bp, Homo sapiens; identical to SEQ ID NO: 2461

SEQ ID NO: 3785 - DNA, 50 bp, Homo sapiens
ggaagaaccgtccagagctgagtgacgctgggatccgggatcaaagttgg

SEQ ID NO: 3786 - DNA, 50 bp, Homo sapiens
tgtgcattgttattgagttgtactgtaccttatttggaaggatgaaggaa

SEQ ID NO: 3787 - DNA, 50 bp, Homo sapiens; identical to SEQ ID NO: 2727

SEQ ID NO: 3788 - DNA, 50 bp, Homo sapiens
agaagcatgtcactttcatgttcctccctaactccctgacctgagaaccc

SEQ ID NO: 3789 - DNA, 50 bp, Homo sapiens
ggatgctcctcccttctctacctcatgggggtattgtataagtccttgca

SEQ ID NO: 3790 - DNA, 50 bp, Homo sapiens
gcaccatctgtcttcatcttccgccatctgatgagcagttgaaatctgga

SEQ ID NO: 3791 - DNA, 50 bp, Homo sapiens; identical to SEQ ID NO: 3790

SEQ ID NO: 3792 - DNA, 50 bp, Homo sapiens; identical to SEQ ID NO: 2358

SEQ ID NO: 3793 - DNA, 50 bp, Homo sapiens
ggcctgttactctccatgactaactgtgtaagtgcttaaaatggaataaa

SEQ ID NO: 3794 - DNA, 50 bp, Homo sapiens; identical to SEQ ID NO: 2847

SEQ ID NO: 3795 - DNA, 50 bp, Homo sapiens
tcttgataccacctatatagatgcagcattttgtatttgtctaactgggg

SEQ ID NO: 3796 - DNA, 50 bp, Homo sapiens; identical to SEQ ID NO: 2443

SEQ ID NO: 3797 - DNA, 50 bp, Homo sapiens; identical to SEQ ID NO: 2477

SEQ ID NO: 3798 - DNA, 50 bp, Homo sapiens
ttgaggggattaatatgaaaacttatgacctcttcctttaggagggagtt

SEQ ID NO: 3799 - DNA, 50 bp, Homo sapiens
tgttaaaacccctatagccaccttttgggaatgttttaaattctccagtt

SEQ ID NO: 3800 - DNA, 50 bp, Homo sapiens
tggcaggcgtcaaccccattttatttgtccttattcctgtggaagcagta

SEQ ID NO: 3801 - DNA, 50 bp, Homo sapiens
aatacacctgcttcacgtccctatgttgggaagtccatatttgtctgctt

SEQ ID NO: 3802 - DNA, 50 bp, Homo sapiens
caggaaatgcagcaacttcaggaaatgcagcaacaaaaatacctactcct

SEQ ID NO: 3803 - DNA, 50 bp, Homo sapiens
aaacccagttgccatctgcgtgacaataaaacattaatgctaacactttt

SEQ ID NO: 3804 - DNA, 50 bp, Homo sapiens
tgctgtattacttctgaaaagactgtgcagtgtgttagttgttggctgaa

SEQ ID NO: 3805 - DNA, 50 bp, Homo sapiens
gtgtatgagagagagagtgtgtgtttgtgtgtttcaaggtcagaacaggt

SEQ ID NO: 3806 - DNA, 50 bp, Homo sapiens; identical to SEQ ID NO: 2025

SEQ ID NO: 3807 - DNA, 50 bp, Homo sapiens
tgtccccttccccaccctctagtgtatttcacagaaaacaaaacctccca

SEQ ID NO: 3808 - DNA, 50 bp, Homo sapiens
agtccagttttatgattctgcttttatgtgtcccttgataacagtgactt

SEQ ID NO: 3809 - DNA, 50 bp, Homo sapiens
aaactcatctgtccaagttcgtggcagaaaggaacgtccttgtgaagacc

SEQ ID NO: 3810 - DNA, 50 bp, Homo sapiens
agagcactgggtagccaagtgatcttcccattcacagagttagtaaacct

SEQ ID NO: 3811 - DNA, 50 bp, Homo sapiens
cccccagagaccccatttgcctctcaacactcagaccttcaactgttttt

SEQ ID NO: 3812 - DNA, 50 bp, Homo sapiens
ccagtgacaccccatattcatcacaaaattaaagcaagaagtccatagta

SEQ ID NO: 3813 - DNA, 50 bp, Homo sapiens
tgacaccaagacccaccccaatccagacttcacacagtattctcccccac

SEQ ID NO: 3814 - DNA, 50 bp, Homo sapiens
gactgcaagtcactcttaggggctgtacttccttagtactggtagcatta

SEQ ID NO: 3815 - DNA, 50 bp, Homo sapiens
aactgagcatcacgaaccctgtttggcagactgaggtcacgatggagggg

SEQ ID NO: 3816 - DNA, 50 bp, Homo sapiens
tcctccattgaagaagaatgtcaacaagaaaggaaaaatagacaaactgg

SEQ ID NO: 3817 - DNA, 50 bp, Homo sapiens
aagtctcgaatgtaattggaatcttcacctcagagtggagttgaactgct

SEQ ID NO: 3818 - DNA, 50 bp, Homo sapiens; identical to SEQ ID NO: 1984

SEQ ID NO: 3819 - DNA, 50 bp, Homo sapiens
acaaaaatagctatatcaagggctggcacctagacattaaactgtacttt

SEQ ID NO: 3820 - DNA, 50 bp, Homo sapiens
gtccaccagtctctgaaattagaacagtaggcggtatgagataatcaggc

SEQ ID NO: 3821 - DNA, 50 bp, Homo sapiens
gaaatgtagctggagtcatcatttagcagagcacggtgtccctgggttgg

SEQ ID NO: 3822 - DNA, 50 bp, Homo sapiens
gcctctgtgatccccatgtgttttgattcctgctctttgttacagttcca

SEQ ID NO: 3823 - DNA, 50 bp, Homo sapiens
aaaacaagaaacaaatgtgcccaccccactttccgcttaactgaaaagct

SEQ ID NO: 3824 - DNA, 50 bp, Homo sapiens
gtaaaaaggctgtctgtgattttccagggtttggtgggggtagggagggg

SEQ ID NO: 3825 - DNA, 50 bp, Homo sapiens
ctgactgagtctcagaatgctcaggaccaaggtgcagagatggacaagag

SEQ ID NO: 3826 - DNA, 50 bp, Homo sapiens
agcttcttgggttcctaattcctggtgtttaataattctctccacgatca

SEQ ID NO: 3827 - DNA, 50 bp, Homo sapiens; identical to SEQ ID NO: 3328

SEQ ID NO: 3828 - DNA, 50 bp, Homo sapiens
atttccagtgagcttatcatgctgtctttacatggggttttcaattttgc

SEQ ID NO: 3829 - DNA, 50 bp, Homo sapiens
tgcagctcaccagccccaggggcagaagagacccaaccacttcctatttt

SEQ ID NO: 3830 - DNA, 50 bp, Homo sapiens; identical to SEQ ID NO: 2415

SEQ ID NO: 3831 - DNA, 50 bp, Homo sapiens
tgtatatagactctggtgttctattgctgagaagcaaaccgccctgcagc

SEQ ID NO: 3832 - DNA, 50 bp, Homo sapiens
atgtcagttctgttttaagtaacagaattgataactgagcaaggaaacgt

SEQ ID NO: 3833 - DNA, 50 bp, Homo sapiens
ttggagctaagctgccacctggttaattaaggtcccaacagtgagttgtg

SEQ ID NO: 3834 - DNA, 50 bp, Homo sapiens
ctttggagggtgtcttctgggtagagggatgggaaggaagggacccttac

SEQ ID NO: 3835 - DNA, 50 bp, Homo sapiens; identical to SEQ ID NO: 2332

SEQ ID NO: 3836 - DNA, 50 bp, Homo sapiens; identical to SEQ ID NO: 2120

SEQ ID NO: 3837 - DNA, 50 bp, Homo sapiens
tttggcttagtgttttcattgcaaattataattgctgtagagccacacac

SEQ ID NO: 3838 - DNA, 50 bp, Homo sapiens; identical to SEQ ID NO: 2596

SEQ ID NO: 3839 - DNA, 50 bp, Homo sapiens
aacaaaagatgaagacctagtgttttggatgggaagcacctgtagaccat

SEQ ID NO: 3840 - DNA, 50 bp, Homo sapiens
acatgtgcaaataaatgtggcttagacttgtgtgactgcttaagactaaa

SEQ ID NO: 3841 - DNA, 50 bp, Homo sapiens; identical to SEQ ID NO: 2583

SEQ ID NO: 3842 - DNA, 50 bp, Homo sapiens; identical to SEQ ID NO: 2141

SEQ ID NO: 3843 - DNA, 50 bp, Homo sapiens
cactcttcacctattgtatgaccaaataaaggttatgctgcttgttacgc

SEQ ID NO: 3844 - DNA, 50 bp, Homo sapiens
tgctaggtgatggagtagaaatggattccctctgggaatggtttcttggt

SEQ ID NO: 3845 - DNA, 50 bp, Homo sapiens
tatgaaaacagtggattggttgggttttgtgcagggtcttgggttagagc

SEQ ID NO: 3846 - DNA, 50 bp, Homo sapiens
tgcatggatcaatcagtgtgattagctttctcagcagacattgtgccata

SEQ ID NO: 3847 - DNA, 50 bp, Homo sapiens; identical to SEQ ID NO: 2356

SEQ ID NO: 3848 - DNA, 50 bp, Homo sapiens
gcagcacactctgagaaagaaacttatcctctcctacacataagaaacca

SEQ ID NO: 3849 - DNA, 50 bp, Homo sapiens
tgcaagacacctgtttatcatcttgtttaaatgtaaatgtccccttatgc

SEQ ID NO: 3850 - DNA, 50 bp, Homo sapiens
tcaacgccaatatgtattctacaaaagagaatggttttaggctccagtgt

SEQ ID NO: 3851 - DNA, 50 bp, Homo sapiens
tggatcatcaaggtgaaacactttggtattctttggcaatcagtgctcct

SEQ ID NO: 3852 - DNA, 50 bp, Homo sapiens
gatacactgtctctcttcataggactgtttaggctctgcatcaagattgc

SEQ ID NO: 3853 - DNA, 50 bp, Homo sapiens
aaggcagggatcatgacacctgaggagtctagtttatggcttcagttgga

SEQ ID NO: 3854 - DNA, 50 bp, Homo sapiens
atggatggactgatctgaaaatcgacctcaactcaagggtggtcagctca

SEQ ID NO: 3855 - DNA, 50 bp, Homo sapiens
tgctaatgtaatcggtttttgtaatggcgtcacaaataaaaggatgctta

SEQ ID NO: 3856 - DNA, 50 bp, Homo sapiens
tgcaagacatagaatagtgttggaaaatgtgcaatatgtgatgtggcaaa

SEQ ID NO: 3857 - DNA, 50 bp, Homo sapiens
aagtttgtgaatgtgactacttagtggtgtatatgagactttcaagggaa

SEQ ID NO: 3858 - DNA, 50 bp, Homo sapiens; identical to SEQ ID NO: 2253

SEQ ID NO: 3859 - DNA, 50 bp, Homo sapiens
ctgtgcctcccccgccacctgtgtgttcttttgatacatttatcttctgt

SEQ ID NO: 3860 - DNA, 50 bp, Homo sapiens
tgtatatttatggtgggaggtggttgggaacttttaacaaaatggggtgt

SEQ ID NO: 3861 - DNA, 50 bp, Homo sapiens
tcctttggaaacagaatgaagcagaggaaactcttaatacttaaaatcgt

SEQ ID NO: 3862 - DNA, 50 bp, Homo sapiens; identical to SEQ ID NO: 2625

SEQ ID NO: 3863 - DNA, 50 bp, Homo sapiens; identical to SEQ ID NO: 1910

SEQ ID NO: 3864 - DNA, 50 bp, Homo sapiens; identical to SEQ ID NO: 2474

SEQ ID NO: 3865 - DNA, 50 bp, Homo sapiens
tgcttgattaagatgccataatagtgctgtatttgcagtgtgggctaaga

SEQ ID NO: 3866 - DNA, 50 bp, Homo sapiens
tcttctgtttcatcctgcggttctggaaccagattttgacttgcgtgtca

SEQ ID NO: 3867 - DNA, 50 bp, Homo sapiens; identical to SEQ ID NO: 2515

SEQ ID NO: 3868 - DNA, 50 bp, Homo sapiens
atgcatctaccgctccttgggaaataatctgaaaggtctaaaaataaaaa

SEQ ID NO: 3869 - DNA, 50 bp, Homo sapiens
cgcaagaagcaggaagaggaaagagaagaaaagcacaacggggaaagata

SEQ ID NO: 3870 - DNA, 50 bp, Homo sapiens
gtagtgtgttgcatccctctcaccctctgatcttcgtcagtcgtgtcatg

SEQ ID NO: 3871 - DNA, 50 bp, Homo sapiens
gagggaaacccggtaataggctgggagtaatccacacacgtgctaacatt

SEQ ID NO: 3872 - DNA, 50 bp, Homo sapiens
cacacactgctacgtgacgtaccactactgccagcgcagcactagctcac

SEQ ID NO: 3873 - DNA, 50 bp, Homo sapiens
ggatcgtgacacaccgggttacacactttccacaccgtaattccatcaat

SEQ ID NO: 3874 - DNA, 50 bp, Homo sapiens
ggttgcaccaaggctgcctaggagaagtgcctgactggactaccccgatc

SEQ ID NO: 3875 - DNA, 50 bp, Homo sapiens
tctgccatctgtctatttcccaattttccttctgactgttcctttctcct

SEQ ID NO: 3876 - DNA, 50 bp, Homo sapiens
ctgtgatattttggtcatgggctggtctggtcggtttcccatttgtctgg

SEQ ID NO: 3877 - DNA, 50 bp, Homo sapiens
tacgacatttgcgaaattcgctaaaaacaagggggagttcacgcggccat

SEQ ID NO: 3878 - DNA, 50 bp, Homo sapiens
gcgcaggttaccggaacccaaggtcctttgaaattcacaactctctttgg

SEQ ID NO: 3879 - DNA, 50 bp, Homo sapiens
agctgtggaaagggcaacctgtggtttctctgtactggtgtttaatgggg

SEQ ID NO: 3880 - DNA, 50 bp, Homo sapiens
cacaaacacccgcccgagcaaccacagacacaggacacgacaccacacac

SEQ ID NO: 3881 - DNA, 50 bp, Homo sapiens
aaagggttacttttcaaaacagtctcctttcgaccggggtcagggtggcc

SEQ ID NO: 3882 - DNA, 50 bp, Homo sapiens
ggtggacagtataaggcggttaagatccgttgatggcgaaggtgagaatg

SEQ ID NO: 3883 - DNA, 50 bp, Homo sapiens
gacagagcgagtagacgggaggcggagaaggaagaggagacgagacgagg

SEQ ID NO: 3884 - DNA, 50 bp, Homo sapiens
caagacacagaggcaacggagagacacgcagacaagcaaggccacggaac

SEQ ID NO: 3885 - DNA, 50 bp, Homo sapiens
agggataggataattacagaggtactgagactcctggcgtgggtgactct

SEQ ID NO: 3886 - DNA, 50 bp, Homo sapiens
cccatcatgaaaaaacgccttaggagccgaagaagaaaacctcgggaaaa

SEQ ID NO: 3887 - DNA, 50 bp, Homo sapiens
gacacagcgagagtccaggaacaggcagacaagcgagaaagaggagaagc

SEQ ID NO: 3888 - DNA, 50 bp, Homo sapiens
gtaggaggcgagaaggaagaacaaggcacaccgaaggagcaagaccagac

SEQ ID NO: 3889 - DNA, 50 bp, Homo sapiens
caagaagcagaagcagcaaccagagacagagagacaaacgcagaacaaca

SEQ ID NO: 3890 - DNA, 50 bp, Homo sapiens
caacaagcagacgaacaacaacaaatatcaacgaggcgcagcagctcaaa

SEQ ID NO: 3891 - DNA, 50 bp, Homo sapiens
aacacacaagagaaacataaccactaaatcactacaaacacacacagaat

SEQ ID NO: 3892 - DNA, 50 bp, Homo sapiens
aaacgaattcttgcactgagagtgttcacagcgccactttcctcctcctc

SEQ ID NO: 3893 - DNA, 50 bp, Homo sapiens
cgagaagcagaagatgacagcagagcgaaagcagagaacgaacagacaag

SEQ ID NO: 3894 - DNA, 50 bp, Homo sapiens
ttggatttattaaagtccctttggaagtcttctaccattactgtagacca

SEQ ID NO: 3895 - DNA, 50 bp, Homo sapiens
tcacataccctatgccgactgagtggaacgagccgactatcacacagagc

SEQ ID NO: 3896 - DNA, 50 bp, Homo sapiens
cacatgcgcaataaacccggcgaagacgccactctgcggcaaaggacaca

SEQ ID NO: 3897 - DNA, 50 bp, Homo sapiens
ccgcagacacgaaagcaccaaccaccgaccgccaccagaaggaacaacag

SEQ ID NO: 3898 - DNA, 50 bp, Homo sapiens
gggcacttaaatggtcacctgtgtaacagtttggtgtaactcccagtgat

SEQ ID NO: 3899 - DNA, 50 bp, Homo sapiens
acaacacgaaaacgaacaagcaaagaaagaaaacggacacgagcgaacca

SEQ ID NO: 3900 - DNA, 50 bp, Homo sapiens; identical to SEQ ID NO: 3894

SEQ ID NO: 3901 - DNA, 50 bp, Homo sapiens
cagccatgtccatgacaaccagagcctgggaggagctggatggcggcctg

SEQ ID NO: 3902 - DNA, 50 bp, Homo sapiens
aaacacacagcaagaaccacgaaaagagcaacccaaaataggaaaagcgg

SEQ ID NO: 3903 - DNA, 50 bp, Homo sapiens
acagcgtggatataaggaccaagagactagggcgcatactatgattcgca

SEQ ID NO: 3904 - DNA, 50 bp, Homo sapiens
atggacacgaggacggaactgggggtactagaacaacccttctctgaaaa

SEQ ID NO: 3905 - DNA, 50 bp, Homo sapiens
agaccaaacgagaaggagaaaaagcaagaccacaaaagacaacaacagcg

SEQ ID NO: 3906 - DNA, 50 bp, Homo sapiens
aaaaaatcgggctttttctgggggaaagggaagggcggggaatgctggcc

SEQ ID NO: 3907 - DNA, 50 bp, Homo sapiens
ctacaacaatacagcacacagcataagcgcacagggcatagactaggcaa

SEQ ID NO: 3908 - DNA, 50 bp, Homo sapiens
caagagagtggagacgagtacgcgagaacgcacgacacagagcgcaagaa

SEQ ID NO: 3909 - DNA, 50 bp, Homo sapiens
tctgctgccctcttaagatctgactgccaaataaatcatcctcatgtcct

SEQ ID NO: 3910 - DNA, 50 bp, Homo sapiens
gatgagaaacaaccacaaggaagagggcagcgccggagacctacagaaag

SEQ ID NO: 3911 - DNA, 50 bp, Homo sapiens
gcgggggcactggctcttcacatttggttgcgagttgcacacaccacaac

SEQ ID NO: 3912 - DNA, 50 bp, Homo sapiens
gggggaagcggaagggttggattgggtgaaaaaagaattgttcgtgttta

SEQ ID NO: 3913 - DNA, 50 bp, Homo sapiens
ataatagaggagagatattgtaaatagagactggcagcagtttccacaaa

SEQ ID NO: 3914 - DNA, 50 bp, Homo sapiens
agtggcaggtgcaattgtcggttcgatttgtgttcccaacagtctgaaat

SEQ ID NO: 3915 - DNA, 50 bp, Homo sapiens
gagcccacggggaagggaacccagcaacacggaaataagttggaccgatc

SEQ ID NO: 3916 - DNA, 50 bp, Homo sapiens
acaacctgagaaataattcggtcaataccagactccaacattcctgatct

SEQ ID NO: 3917 - DNA, 50 bp, Homo sapiens
gtctattacaaagtaaagagagtcaattactccaggaggagaattgcagg

SEQ ID NO: 3918 - DNA, 50 bp, Homo sapiens
accagacacggacacacacgaacacaagaaaacacaaaacaagagcaacc

SEQ ID NO: 3919 - DNA, 50 bp, Homo sapiens
cggttgggtcctcaaaatatgcctgtttggttaacaaaagcggttgtgaa

SEQ ID NO: 3920 - DNA, 50 bp, Homo sapiens
gataaagaaggggcgcgggaaacagcgagggaaggacgggctgggagaac

SEQ ID NO: 3921 - DNA, 50 bp, Homo sapiens
atctctggcaatactgtctgattacgggggtgatgccgacggttaaaaac

SEQ ID NO: 3922 - DNA, 50 bp, Homo sapiens
gaacacaaaaaacctcttctataacggggacacacgccaaggggacaagt

SEQ ID NO: 3923 - DNA, 50 bp, Homo sapiens
ttgggtgcaacaaccaatacacttatacttggaaaccacgggccatatta

SEQ ID NO: 3924 - DNA, 50 bp, Homo sapiens
aggaggaacaaaaaccgcagcgtggatttcaaatttctggaagtaagtct

SEQ ID NO: 3925 - DNA, 50 bp, Homo sapiens
aaattcgcgcaccctttgttttattgccccggttacaaggttttgaactg

SEQ ID NO: 3926 - DNA, 50 bp, Homo sapiens
cgggccagtatgaatgtagggtcaaggaacgccgagggtttcacaaaagg

SEQ ID NO: 3927 - DNA, 50 bp, Homo sapiens
ctcagtgtagggcagagaggtctaacaccaacataaggtactagcagtgt

SEQ ID NO: 3928 - DNA, 50 bp, Homo sapiens
agaatatatgtattttgaaaggaaaggacttggggatttttaacagggca

SEQ ID NO: 3929 - DNA, 50 bp, Homo sapiens
gagactctcgttgtctcctcttctgctctcttctctgttggaggggagga

SEQ ID NO: 3930 - DNA, 50 bp, Homo sapiens
aggttgtggggagtatgtttggaccaaaaattaaaatattgtgggaggga

SEQ ID NO: 3931 - DNA, 50 bp, Homo sapiens
gaccttacctggtggttttgtggtttgttctcccgaaaaatgcggggttt

SEQ ID NO: 3932 - DNA, 50 bp, Homo sapiens
caccctgggttttaaagtgtgggagaaaagcgcccggaagaaggaaacaa

SEQ ID NO: 3933 - DNA, 50 bp, Homo sapiens
gaggggaccggccatctgggcaagcagatatgctaattgggaattatagg

SEQ ID NO: 3934 - DNA, 50 bp, Homo sapiens
atgacttgtgaatacctgagttatactttcccaacagatgtgcctaacac

SEQ ID NO: 3935 - DNA, 50 bp, Homo sapiens
tgatagctcacttagttaattgttttgaagcaaattttgggttggatggg

SEQ ID NO: 3936 - DNA, 50 bp, Homo sapiens
gacacagaagagagacagaagagaaacggtcgaggagaagaagcaggagc

SEQ ID NO: 3937 - DNA, 50 bp, Homo sapiens
aaagaccagagacagggagacacggcagacagagcgccgacaaagaagag

SEQ ID NO: 3938 - DNA, 50 bp, Homo sapiens
caaggcgacatgggagagcgagaaggctaggaggacgacagacaaggaaa

SEQ ID NO: 3939 - DNA, 50 bp, Homo sapiens
gaattttggggaggttactggtcgggggaaataacagggttggacaaacg

SEQ ID NO: 3940 - DNA, 50 bp, Homo sapiens
ctccacatatgggtaacacactcggtccttacaagcacctagtcacttcc

SEQ ID NO: 3941 - DNA, 50 bp, Homo sapiens
gggaccagactgctttctaaatgcacagctctttcactatcagaatgtgt

SEQ ID NO: 3942 - DNA, 50 bp, Homo sapiens
tgtggtcacttgggaaataaattccatctggcttacccaatgggtggtgg

SEQ ID NO: 3943 - DNA, 50 bp, Homo sapiens
ccacagccacaacaccagacaagccgaccaacagacagatacagaccacc

SEQ ID NO: 3944 - DNA, 50 bp, Homo sapiens
accacagcaagacaacaaggacgagaaagagaacagacaatgagcaacga

SEQ ID NO: 3945 - DNA, 50 bp, Homo sapiens
actactgcttgcgtacctctccgctttccctctccttactatcgaccata

SEQ ID NO: 3946 - DNA, 50 bp, Homo sapiens
tccgtttatattagcactgtatcccttgtgccatccaacattttgtatgt

SEQ ID NO: 3947 - DNA, 50 bp, Homo sapiens
cgggcgcaggacagtagcagagaagagaggtggagagccggacaacgcag

SEQ ID NO: 3948 - DNA, 50 bp, Homo sapiens
cttcagtcattatgggctcagtttcctcactattggttcctcgcaaggga

SEQ ID NO: 3949 - DNA, 50 bp, Homo sapiens
aagagcaacaacgaggcgaagaggaaggaggaggcaagacagaagaggaa

SEQ ID NO: 3950 - DNA, 50 bp, Homo sapiens
gaggagcaacgaccagagagacgaactgacatcaaccatagaagacgaca

SEQ ID NO: 3951 - DNA, 50 bp, Homo sapiens
aagcatgaagaagacctggatgaggctcagggaggttcccccagtttaaa

SEQ ID NO: 3952 - DNA, 50 bp, Homo sapiens
atcagtcaatcagtcagcttctcagagtagcaatccatgtgtccagagga

SEQ ID NO: 3953 - DNA, 50 bp, Homo sapiens
aaatccaatccttcggagagggaatgggcggtattaattaagggaagtcc

SEQ ID NO: 3954 - DNA, 50 bp, Homo sapiens
atgacaagacaagccagacgaagaagacaaacaagggagacacagcagac

SEQ ID NO: 3955 - DNA, 50 bp, Homo sapiens
tgcgccccaatatttgtggaacagcgttttgttcgaataaaacgatcggt

SEQ ID NO: 3956 - DNA, 50 bp, Homo sapiens
ctcgaggtgtaactcaggaaggcctagcgaatcccgactcggatggtgtc

SEQ ID NO: 3957 - DNA, 50 bp, Homo sapiens
ttcacctactctgttcttttcatccatcccctgagtcagttggttggagg

SEQ ID NO: 3958 - DNA, 50 bp, Homo sapiens
ctgttgtctggagtgtggagtctcttgtctggattgtggagtctcttgtc

SEQ ID NO: 3959 - DNA, 50 bp, Homo sapiens
caagatgatgcttgctgtcttttcctctcggctacccagaatggcatttg

SEQ ID NO: 3960 - DNA, 50 bp, Homo sapiens
agtactcatgacttgagagacgtggacggagccagcttctaccttgcttg

SEQ ID NO: 3961 - DNA, 50 bp, Homo sapiens
ggtccgaccaattaatgactccatgatcggcctcggttttcacaaacctt

SEQ ID NO: 3962 - DNA, 50 bp, Homo sapiens
agacaaagagagcataaatatagctctactcatgggtaccataccagtgt

SEQ ID NO: 3963 - DNA, 50 bp, Homo sapiens
ttacatttgtggaccatgttacagttaaagaaaaatcctgtttcagtcct

SEQ ID NO: 3964 - DNA, 50 bp, Homo sapiens
gcaggttatcgcaagatgtcttagagtagggttaaggttctcagtgacac

SEQ ID NO: 3965 - DNA, 50 bp, Homo sapiens
atttttaaatggctttaccaaacattgtcagtacctttacgtgttagaag

SEQ ID NO: 3966 - DNA, 50 bp, Homo sapiens
ctttccacagcaattgttttgtacgaggggccttacagcgcggtccactt

SEQ ID NO: 3967 - DNA, 50 bp, Homo sapiens
ttctacagcacgatgcctggatctactgacctgtcaaccacgaatcttga

SEQ ID NO: 3968 - DNA, 50 bp, Homo sapiens
gaaacagcaacaagcaaacaggatctcagcattaccaacagccagcacta

SEQ ID NO: 3969 - DNA, 50 bp, Homo sapiens
tgagcctgaacttttttagcaaattattattctcagtttccattacctgt

SEQ ID NO: 3970 - DNA, 50 bp, Homo sapiens
ccttccaaagcggtcacctgatagggaagtcttacggctaggaagttaca

SEQ ID NO: 3971 - DNA, 50 bp, Homo sapiens
gaatggtggggagaaaaaaggggggcacagtcatgatcggctcttataat

SEQ ID NO: 3972 - DNA, 50 bp, Homo sapiens
gtcacataatccggggacccaaagaaagttctccagagtggtttcacgag

SEQ ID NO: 3973 - DNA, 50 bp, Homo sapiens
acaacaacacatcacgtaaccacaacacgcataaacagcaaatcatccta

SEQ ID NO: 3974 - DNA, 50 bp, Homo sapiens
cagaacaccaacaagcagggacggaagccgaccgagcaaacagcgaaggg

SEQ ID NO: 3975 - DNA, 50 bp, Homo sapiens
gtggacggcctgggaatgtgccccccggtgtaacatcgagcccacaatgg

SEQ ID NO: 3976 - DNA, 50 bp, Homo sapiens
aggattaggagagggtcacagaacagaaagcagattacacttgggatgga

SEQ ID NO: 3977 - DNA, 50 bp, Homo sapiens
ctctgtttgtctggccgcctccgtgatcaaaccgtgtcgtcggcgtgttc

SEQ ID NO: 3978 - DNA, 50 bp, Homo sapiens
ggcttggacattgctctcaagaagattaagaaccctggaggaacactagg

SEQ ID NO: 3979 - DNA, 50 bp, Homo sapiens
tgtacagctaaatttctccaaagcactttttcaaaaccaaaaaagaaaaa

SEQ ID NO: 3980 - DNA, 50 bp, Homo sapiens
tttgcacactgaacacttacagatgtggcagatgtgaaatttgtcatcaa

SEQ ID NO: 3981 - DNA, 50 bp, Homo sapiens
acagagagtcacccgcgagtacgaaacaggcacatttttagaaactcaca

SEQ ID NO: 3982 - DNA, 50 bp, Homo sapiens
aggttcttaccaccacttttgtgcccatctttcccttcgttcccaatgtg

SEQ ID NO: 3983 - DNA, 50 bp, Homo sapiens
ccggggtggccctctcaaatttggcatggggtcctctttcaatgttgtgg

SEQ ID NO: 3984 - DNA, 50 bp, Homo sapiens
cacgagcggctggaggacacccattttgtgcagtgcccgtccgtcccttc

SEQ ID NO: 3985 - DNA, 50 bp, Homo sapiens; identical to SEQ ID NO: 834

SEQ ID NO: 3986 - DNA, 50 bp, Homo sapiens
ggtgtgtctcgcggctggcccagtctattctcggtgtttatcttcatcac

SEQ ID NO: 3987 - DNA, 50 bp, Homo sapiens
gacaacggaaactctgtctctaccaccatgtgacagacgcgttgatgcgt

SEQ ID NO: 3988 - DNA, 50 bp, Homo sapiens
caagacacaaacagcacgactcacacagagaaagcaaccatgccgaggag

SEQ ID NO: 3989 - DNA, 50 bp, Homo sapiens
cgcgtcgaacttcgggacattcccgtaaaccacaaacagataaagaatta

SEQ ID NO: 3990 - DNA, 50 bp, Homo sapiens
gcgtaaagtgatcaaaaggccctgaaggggaaaatgataaaacccgtggt

SEQ ID NO: 3991 - DNA, 50 bp, Homo sapiens
agaggaagcgtgtgaatacaacaatctaaaaaggaggagaggtcgagcac

SEQ ID NO: 3992 - DNA, 50 bp, Homo sapiens
acacattccccataccatttcgtgttattcacattccccgtaccatttct

SEQ ID NO: 3993 - DNA, 50 bp, Homo sapiens
taaaaagggggtggcggctgtagtaaggaggagcgagtaatgtatagcac

SEQ ID NO: 3994 - DNA, 50 bp, Homo sapiens
ccatgagcaggcgcaaccataacagttagagacggcacacagcacgacac

SEQ ID NO: 3995 - DNA, 50 bp, Homo sapiens
actcacgcaagagcagggggactataacagaaataaacaagtaaataaat

SEQ ID NO: 3996 - DNA, 50 bp, Homo sapiens
tacacaggcagctatgcggatcatcagacgagcacatattctaacagaga

SEQ ID NO: 3997 - DNA, 50 bp, Homo sapiens
cgtcgccgtaggacgcctccgtcgtcgtctggtctgtctcctgcatcgag

SEQ ID NO: 3998 - DNA, 50 bp, Homo sapiens
aaaggcaagagtccggggtggcagaagagtgaaaaatgaaagagagaagg

SEQ ID NO: 3999 - DNA, 50 bp, Homo sapiens
ttctgcccagagtgtatttgtgaagagtctcttatattatgttttgtgga

SEQ ID NO: 4000 - DNA, 50 bp, Homo sapiens
gtgcgaatgtggagtgttttacattgatctttgctaatgaattagcatca

SEQ ID NO: 4001 - DNA, 50 bp, Homo sapiens
cattacgcatattggtaagacgcaaaatgagacagatcgacactgggacg

SEQ ID NO: 4002 - DNA, 50 bp, Homo sapiens
cacaacgggtcttaatgacgacggaaagatacatccatcggtatgaacgc

SEQ ID NO: 4003 - DNA, 50 bp, Homo sapiens
accagcaatccgcagcagagtcataagtggggtaggtgatatgtactaac

SEQ ID NO: 4004 - DNA, 50 bp, Homo sapiens
gaaaaaacaagctaacaaacacacacgcccacaccaacatgccagaacgc

SEQ ID NO: 4005 - DNA, 50 bp, Homo sapiens
tgaacatgggtgggtttgatcacgaggattccgctgaaaagattagaggg

SEQ ID NO: 4006 - DNA, 50 bp, Homo sapiens
cgcgttcataacggcgtcgactgttcttgtgctgctgttatctatactat

SEQ ID NO: 4007 - DNA, 50 bp, Homo sapiens
gggaccagactacacggaataccagagttgaagaaaattaagatttaagc

SEQ ID NO: 4008 - DNA, 50 bp, Homo sapiens
tatactgagagtgaaggtctgggtgccaacttgagacaggtggtctagga

SEQ ID NO: 4009 - DNA, 50 bp, Homo sapiens
cccctggttttctcgttctgcctcctttggacctgtgtttgttttctgct

SEQ ID NO: 4010 - DNA, 50 bp, Homo sapiens
cccttagaatggttactgcccttgaattaacttgacacaacttgggttgg

SEQ ID NO: 4011 - DNA, 50 bp, Homo sapiens
cgaataatccctatttgattacctcagaaaagttttgtcttccgccaagg

SEQ ID NO: 4012 - DNA, 50 bp, Homo sapiens
ttggaccccagggtaaggcggatattggttgggacgttcggggagtgtat

SEQ ID NO: 4013 - DNA, 50 bp, Homo sapiens
aattacgttcggaggtatataaaaagggatcggcgcagtggatagggggt

SEQ ID NO: 4014 - DNA, 50 bp, Homo sapiens
ggagatccacagtgatctcaggccctggaccggaaaaggcagcaagatca

SEQ ID NO: 4015 - DNA, 50 bp, Homo sapiens
aagacgagtacaccaagaccaaagagcgccaacgagcacgaccgagtgaa

SEQ ID NO: 4016 - DNA, 50 bp, Homo sapiens
aacgccgactagacgtcacaaagacttaataagaaacacactgatatcca

SEQ ID NO: 4017 - DNA, 50 bp, Homo sapiens
cgcaacattatccatttaaacccctgcataacccattaccaaagccctct

SEQ ID NO: 4018 - DNA, 50 bp, Homo sapiens
ggcaccccaatccccggcaaaaacatttgttaacctcttgggaatttctt

SEQ ID NO: 4019 - DNA, 50 bp, Homo sapiens
ctcgtctgcaccggagtctcacaaatttagcatctgggtcttgagcatta

SEQ ID NO: 4020 - DNA, 50 bp, Homo sapiens
ccctccggggtctctatacccacaaccttctatcactcaatcagttggta

SEQ ID NO: 4021 - DNA, 50 bp, Homo sapiens
aacaagatagagagaagacgaagatcgacacagacaaacaaccacaaccg

SEQ ID NO: 4022 - DNA, 50 bp, Homo sapiens
tgttgggacccctcatctcacgggtcatttccaccactaaacgccctttt

SEQ ID NO: 4023 - DNA, 50 bp, Homo sapiens
ccctgaaatcctaaattccgtcacccctccaacatgaccataaaagtccc

SEQ ID NO: 4024 - DNA, 50 bp, Homo sapiens
gaccacgttatgtgcctgacttcgaggacaccctctctggtttggtattt

SEQ ID NO: 4025 - DNA, 49 bp, Homo sapiens
tctcctttcagttcctttgtaggatttctggccttgaggatagtcttca

SEQ ID NO: 4026 - DNA, 50 bp, Homo sapiens
tctcatcaacatttgactctcagaagagcctccatttgccctttctctct

SEQ ID NO: 4027 - DNA, 50 bp, Homo sapiens
gcagagcagaccttattacgcacaattgccggtaacatgtaacaccagtt

SEQ ID NO: 4028 - DNA, 50 bp, Homo sapiens
attgggcatggttggtccaatgcctcacatggccgggataacaggacgca

SEQ ID NO: 4029 - DNA, 50 bp, Homo sapiens
caaagggtgtaattccacattgacactcctgtcatgcggtgggcgggaac

SEQ ID NO: 4030 - DNA, 50 bp, Homo sapiens
ctagctcactagttgtgcctatatgccacaccgggggacccaacaagggt

SEQ ID NO: 4031 - DNA, 50 bp, Homo sapiens
atactgtgtgatttgcccttgctgtccaaccctgttcttgctgccattta

SEQ ID NO: 4032 - DNA, 50 bp, Homo sapiens
gtggcctgaagtgacccattctatgaattgttaattaaggtgccaaaaaa

SEQ ID NO: 4033 - DNA, 50 bp, Homo sapiens
gggtttgagacttgggtatggaaacagaaccggaaattgtgtgctctggt

SEQ ID NO: 4034 - DNA, 50 bp, Homo sapiens
atttctattatggaatccctggggttcagaatgtaactttgtacatgaga

SEQ ID NO: 4035 - DNA, 50 bp, Homo sapiens
gacagtacacctcagggaagggacaaacaaacacgataaatcgacacacg

SEQ ID NO: 4036 - DNA, 50 bp, Homo sapiens
tcagacccagtcttgtggatggaaatgtagtgctcgagtcacattctgct

SEQ ID NO: 4037 - DNA, 50 bp, Homo sapiens
tcctgagccccacacgcccgaagcaataaagagtccactgacttccaaaa

SEQ ID NO: 4038 - DNA, 50 bp, Homo sapiens
acgaatatcgaatctcccacgcggggggtgagacccgaatctgcggctgc

SEQ ID NO: 4039 - DNA, 50 bp, Homo sapiens
agacacacgagcaaaacgacgcagcaagaatcagatagcatagcaaacat

SEQ ID NO: 4040 - DNA, 50 bp, Homo sapiens
gcagtgggacggaacgggtgaagcctgatggctgatgcggcacgatcttg

SEQ ID NO: 4041 - DNA, 50 bp, Homo sapiens
ctttaaatcttagattgctccgcacagataaagagaaccaggattggggc

SEQ ID NO: 4042 - DNA, 50 bp, Homo sapiens
tttatttgggtacttttccccaacacaagtccttttatcccacccttggg

SEQ ID NO: 4043 - DNA, 50 bp, Homo sapiens
aaaagatctcggaaaatagcattttgttaaaaccttggggggtaaaaccc

SEQ ID NO: 4044 - DNA, 50 bp, Homo sapiens
aaccttcatgcaagtggagacgggtagggggttctatggggcattggttg

SEQ ID NO: 4045 - DNA, 50 bp, Homo sapiens
tgtgaaaagctgataagaaaaccatccagaaaaaagctcttcgttttaca

SEQ ID NO: 4046 - DNA, 50 bp, Homo sapiens
tcattataattctgtcctaggaaatcaaattagaacgctccacaagccgg

SEQ ID NO: 4047 - DNA, 50 bp, Homo sapiens
cgcagagctgggccttacaaatgggttccaaatcgggcttctcactcagg

SEQ ID NO: 4048 - DNA, 50 bp, Homo sapiens
tacaactgtaccacactgggttactctagaagtctctggtcggatccttc

SEQ ID NO: 4049 - DNA, 50 bp, Homo sapiens
catagagcacaagagacacatggaccggcacgcgacccgacccaaagcgc

SEQ ID NO: 4050 - DNA, 50 bp, Homo sapiens
tttacctcatttatttggtactttccccacacagtcctttatccacctgg

SEQ ID NO: 4051 - DNA, 50 bp, Homo sapiens
ccatttttagtgggggagaaaactgtcactgtgctggcgaaagaggtcca

SEQ ID NO: 4052 - DNA, 50 bp, Homo sapiens
ccgcaccgattaacggccagagaagcaacaagcaaataaaaagtgggaaa

SEQ ID NO: 4053 - DNA, 50 bp, Homo sapiens
aacttaactcactggcgagaatacagcgtgggacccttcagccactacaa

SEQ ID NO: 4054 - DNA, 50 bp, Homo sapiens
aggacttaacgggaatacgggaataactccaattacttcatctctagggc

SEQ ID NO: 4055 - DNA, 50 bp, Homo sapiens
aaggaggttgctcaccagtagtgcttgttaccaaaatgtcaccaggagtt

SEQ ID NO: 4056 - DNA, 50 bp, Homo sapiens
tgaattaagtgcattatcaattaaccttatggtggttggaatagtgatca

SEQ ID NO: 4057 - DNA, 50 bp, Homo sapiens
aaacacacaggaaaagggcaaagggggcaccaggagaaccgggagacaaa

SEQ ID NO: 4058 - DNA, 50 bp, Homo sapiens
cggagaaacggggccaaaaggttgccgagagacccggcgaaaaggacagg

SEQ ID NO: 4059 - DNA, 50 bp, Homo sapiens
acaaagcatcaaacagcagggagctagtggagaggtctattgtcccagtg

SEQ ID NO: 4060 - DNA, 50 bp, Homo sapiens
gggtgcatgccaagaaagtatggttggaattcctggtacactgaagtgga

SEQ ID NO: 4061 - DNA, 50 bp, Homo sapiens
atgttatcttgggaattagtgtcttgagcctctgtctgttaccgtagttt

SEQ ID NO: 4062 - DNA, 50 bp, Homo sapiens
tgaccgagtaaaaaacatctatcaattacacaaatgaacaagaatgtgag

SEQ ID NO: 4063 - DNA, 50 bp, Homo sapiens
acaagaaatggttgaggcgaatattggaaacacatgggcttaatgctgaa

SEQ ID NO: 4064 - DNA, 50 bp, Homo sapiens
ggtattgatgcttggtttttcctgccagtccgaaattcctgtatttgtca

SEQ ID NO: 4065 - DNA, 50 bp, Homo sapiens
tcatgctacttgtcctggttttgtcattgatactctcatagcccttttga

SEQ ID NO: 4066 - DNA, 50 bp, Homo sapiens
gcctggcggaccggcagcctatatgacggacttcctcattacttaccacg

SEQ ID NO: 4067 - DNA, 50 bp, Homo sapiens
aaactgtttggagaatttaagcactctctgatgggggacaactctatgga

SEQ ID NO: 4068 - DNA, 50 bp, Homo sapiens
tctttgtgcagatacgttcaccacataagtgtgagccatttaaacctggt

SEQ ID NO: 4069 - DNA, 50 bp, Homo sapiens
caccaaagtggagacaaatacatgatctcaaagatacacagtacctactt

SEQ ID NO: 4070 - DNA, 50 bp, Homo sapiens
aataattggtcttttaaacaaacacggaagtttggtggaatcggtcatgt

SEQ ID NO: 4071 - DNA, 50 bp, Homo sapiens
tgttcgtgccttccttctgggttccacaaaggtgggaccttacttatcta

SEQ ID NO: 4072 - DNA, 50 bp, Homo sapiens
agggaaaaacgcagggggttcaaaaactctctcactctatgcagtgtata

SEQ ID NO: 4073 - DNA, 50 bp, Homo sapiens
aagcagctcaatagcagcatagaggattagattaatggaacagcactgca

SEQ ID NO: 4074 - DNA, 50 bp, Homo sapiens
acatatacaaggacacagaggaaaggcgggaacaacgggaagaggttttg

SEQ ID NO: 4075 - DNA, 50 bp, Homo sapiens
tgtggcgattaagagaggtgaagcataactgatttgcaggatatggtttg

SEQ ID NO: 4076 - DNA, 50 bp, Homo sapiens
aaaagccaaaaggtttcatgtagattttagttcactaaagggtgcccaca

SEQ ID NO: 4077 - DNA, 50 bp, Homo sapiens
gcagaactctaattgtacggggtcacagaggcgtgatatggtatcccaaa

SEQ ID NO: 4078 - DNA, 50 bp, Homo sapiens
cttaaccatacagaatgatataactcctgtgcaatgaaggtgataacagt

SEQ ID NO: 4079 - DNA, 50 bp, Homo sapiens
cttcggaggctaggccgccgctccagctttgcacgtttcgatcccaaagg

SEQ ID NO: 4080 - DNA, 50 bp, Homo sapiens
caaagtcaaataactcctcattgtaaacaaactgtgtaactgcccaaagc

SEQ ID NO: 4081 - DNA, 50 bp, Homo sapiens
ccaatcccgatccaaatcataatttgttcttaagtatactgggcaggtcc

SEQ ID NO: 4082 - DNA, 50 bp, Homo sapiens
tccagctcctgttccttggaaaatctccattgtatgtgcattttttaaat

SEQ ID NO: 4083 - DNA, 50 bp, Homo sapiens
aactgatgcctgctagtgctttctgattactcgcattctgtttcttgctt

SEQ ID NO: 4084 - DNA, 50 bp, Homo sapiens
tcaggttgaagtcaagatgacagataaggtgagagtaatgactactccaa

SEQ ID NO: 4085 - DNA, 50 bp, Homo sapiens
tcctaggtagggtttaatccccagtaaaattgccatattgcacatgtctt

SEQ ID NO: 4086 - DNA, 50 bp, Homo sapiens; identical to SEQ ID NO: 2481

SEQ ID NO: 4087 - DNA, 50 bp, Homo sapiens
gaggccctagcatttctccttggataggggaccagagagagcttggaatg

SEQ ID NO: 4088 - DNA, 50 bp, Homo sapiens; identical to SEQ ID NO: 2188

SEQ ID NO: 4089 - DNA, 50 bp, Homo sapiens; identical to SEQ ID NO: 2057

SEQ ID NO: 4090 - DNA, 50 bp, Homo sapiens
tttacctctgtcttggctttcatgttattaaacgtatgcatgtgaagaag

SEQ ID NO: 4091 - DNA, 50 bp, Homo sapiens
gggaagttggtttataagcctttgccaggtgtaactgttgtgaaataccc

SEQ ID NO: 4092 - DNA, 50 bp, Homo sapiens
ccctcccttcagattatgttaactctgagtctgtccaaatgagttcactt

SEQ ID NO: 4093 - DNA, 50 bp, Homo sapiens; identical to SEQ ID NO: 3369

SEQ ID NO: 4094 - DNA, 50 bp, Homo sapiens; identical to SEQ ID NO: 2819

SEQ ID NO: 4095 - DNA, 50 bp, Homo sapiens
tatggccttcaagctcaagtccaaatcctgccatgacctctctgtactct

SEQ ID NO: 4096 - DNA, 50 bp, Homo sapiens
tccatctgtgcataaggagaggaaagttccagggtgtgtatgttttcagg

SEQ ID NO: 4097 - DNA, 50 bp, Homo sapiens
ggaccattccggagcagccccacatacctcactgtctcgtctgtctatgt

SEQ ID NO: 4098 - DNA, 50 bp, Homo sapiens; identical to SEQ ID NO: 3153

SEQ ID NO: 4099 - DNA, 50 bp, Homo sapiens; identical to SEQ ID NO: 2269

SEQ ID NO: 4100 - DNA, 50 bp, Homo sapiens
aaatctattctaacgcaaaaccactaactgaagttcagataatggatggt

SEQ ID NO: 4101 - DNA, 50 bp, Homo sapiens
tgttataaaagaggattttcccaccttgacaccaggcaatgtagttagca

SEQ ID NO: 4102 - DNA, 50 bp, Homo sapiens
accaggatgcaatggatttatttgattcaggggacctgtatttccatgtc

SEQ ID NO: 4103 - DNA, 50 bp, Homo sapiens
aacagaaacagctatggcaacagcatcaccctcagagcatcaccaacttg

SEQ ID NO: 4104 - DNA, 50 bp, Homo sapiens
tatttaacctgagtatagtatttaacgaagcctagaagcacggctgtggg

SEQ ID NO: 4105 - DNA, 50 bp, Homo sapiens; identical to SEQ ID NO: 860

SEQ ID NO: 4106 - DNA, 50 bp, Homo sapiens
atagcaagctgaactgtcctaaggcaggggcgagcacggaacaatggggc

SEQ ID NO: 4107 - DNA, 50 bp, Homo sapiens
tgacaggttcacttctgaggttgctatgagggtgatggaatgtactgcct

SEQ ID NO: 4108 - DNA, 50 bp, Homo sapiens; identical to SEQ ID NO: 2223

SEQ ID NO: 4109 - DNA, 50 bp, Homo sapiens
ttgaaattggtggcttcattctagatgtagcttgtgcagatgtagcagga

SEQ ID NO: 4110 - DNA, 50 bp, Homo sapiens
acttcttatacatttgataaagtaaggcatggttgtggttaatctggttt

SEQ ID NO: 4111 - DNA, 50 bp, Homo sapiens
catgaagaagcaagacgaaaacacacaggagggaaaatcctgggattctt

SEQ ID NO: 4112 - DNA, 50 bp, Homo sapiens
gcctggcttggaccttggcattccgtttgaattccttctaactggaacat

SEQ ID NO: 4113 - DNA, 50 bp, Homo sapiens
gtccactgtcactgtttctctgctgttgcaaatacatggataacacattt

SEQ ID NO: 4114 - DNA, 50 bp, Homo sapiens
ttgtgttgttggaaaaagtcacattgccattaaactttccttgtctgtct

SEQ ID NO: 4115 - DNA, 50 bp, Homo sapiens
cagtagcgacagcgacggcggagacgagggcgtgagtcaggaggagagac

SEQ ID NO: 4116 - DNA, 50 bp, Homo sapiens
agctgccacgggtgagagagcaggaggtatgaattaaaagtctacagcac

SEQ ID NO: 4117 - DNA, 50 bp, Homo sapiens
ctttcctcaaaatctttaagccagaggcagccttcctgccggagtggaca

SEQ ID NO: 4118 - DNA, 50 bp, Homo sapiens
tctgcctcacgtgcactgtggtggccgtgtgctacggctccttctacaat

SEQ ID NO: 4119 - DNA, 50 bp, Homo sapiens
ccatagcccaaggtgacatttcccaccctgtgccgtgttccccaataaaa

SEQ ID NO: 4120 - DNA, 50 bp, Homo sapiens
ggggtatccagaattggttgtaaatactttgcatattgtctgattaaaca

SEQ ID NO: 4121 - DNA, 50 bp, Homo sapiens
gaggctttgccttgcctgcatatttgtttcgctcttactcagtttgggaa

SEQ ID NO: 4122 - DNA, 50 bp, Homo sapiens; identical to SEQ ID NO: 3320

SEQ ID NO: 4123 - DNA, 50 bp, Homo sapiens
ttgcaaaacccagaagctaaaaagtcaataaacagaaagaatgattttga

SEQ ID NO: 4124 - DNA, 50 bp, Homo sapiens; identical to SEQ ID NO: 1636

SEQ ID NO: 4125 - DNA, 50 bp, Homo sapiens
aaaagaagccctaataaaccacccggataataaccctgtctaccatcttt

SEQ ID NO: 4126 - DNA, 50 bp, Homo sapiens
gtgaagattcctgaggatctaacttgcagttggacactatgttacatact

SEQ ID NO: 4127 - DNA, 50 bp, Homo sapiens
agaaggattagcagttcttagtaagtttactgtgtataggaacggtttgt

SEQ ID NO: 4128 - DNA, 50 bp, Homo sapiens
cggctgcctctcttgagaccatctgccaatcacacagtaactattcgggt

SEQ ID NO: 4129 - DNA, 49 bp, Homo sapiens
cccaactgaggaccactgtctacagagtcaggaaatattgtagggagaa

SEQ ID NO: 4130 - DNA, 50 bp, Homo sapiens; identical to SEQ ID NO: 2058

SEQ ID NO: 4131 - DNA, 50 bp, Homo sapiens; identical to SEQ ID NO: 3479

SEQ ID NO: 4132 - DNA, 50 bp, Homo sapiens
ggagccaagtccagatttacactgggagaggtgccagcaactgaataaat

SEQ ID NO: 4133 - DNA, 50 bp, Homo sapiens; identical to SEQ ID NO: 3789

SEQ ID NO: 4134 - DNA, 50 bp, Homo sapiens
taacttcaatgtagttttccatccttcaaataaacatgtctgcccccatg

SEQ ID NO: 4135 - DNA, 50 bp, Homo sapiens
gagtccttttgatttttaacttattccccatgtccctatacttcgtgtgc

SEQ ID NO: 4136 - DNA, 50 bp, Homo sapiens; identical to SEQ ID NO: 2854

SEQ ID NO: 4137 - DNA, 50 bp, Homo sapiens
cagcttcagctaggagtttgtaagcaaggactttgtgacacatttgtccc

SEQ ID NO: 4138 - DNA, 50 bp, Homo sapiens
aattgaaaagtaccaagaagtggaagaagaccaagacccatcatgcccca

SEQ ID NO: 4139 - DNA, 50 bp, Homo sapiens
acttcctagagacttgtttctgagacagttctttgccttcacttccctgc

SEQ ID NO: 4140 - DNA, 50 bp, Homo sapiens
acaactgacctgtctccttcacatagtccatatcaccacaaatcacacaa

SEQ ID NO: 4141 - DNA, 50 bp, Homo sapiens
gctcaggagcgggctgctgagagctaaacccagcaattttctatgatttt

SEQ ID NO: 4142 - DNA, 50 bp, Homo sapiens
aaagaaagccagtatattggtttgaaatatagagatgtgtcccaatttca

SEQ ID NO: 4143 - DNA, 50 bp, Homo sapiens
actggcaggcttatttatctgttgcacttggttagctttaattgttctgt

SEQ ID NO: 4144 - DNA, 50 bp, Homo sapiens; identical to SEQ ID NO: 2256

SEQ ID NO: 4145 - DNA, 50 bp, Homo sapiens
caactgtgctggccgggaggagagcagagacgcagtcctgcccagtgtag

SEQ ID NO: 4146 - DNA, 50 bp, Homo sapiens
cacatggctaaagaaggtttcagaaagaagtggggacagagcagaacttt

SEQ ID NO: 4147 - DNA, 50 bp, Homo sapiens
ccgacatctggttcctacttcagggtcataaagcctaaatagcccacacg

SEQ ID NO: 4148 - DNA, 50 bp, Homo sapiens
ctcatttgtattcaagcctttaacaggagggcaaagaggtgagaatgtgt

SEQ ID NO: 4149 - DNA, 50 bp, Homo sapiens; identical to SEQ ID NO: 1928

SEQ ID NO: 4150 - DNA, 50 bp, Homo sapiens
gcagacactgcttcttacttctgtgctacggatgggaacagagatgacaa

SEQ ID NO: 4151 - DNA, 50 bp, Homo sapiens
ggggaaactggaggcttcaaaactatctttggagcaggaacaagactatt

SEQ ID NO: 4152 - DNA, 50 bp, Homo sapiens
ggggaaggagggtgattatattgctttgtaatggtttgtgatacttgaaa

SEQ ID NO: 4153 - DNA, 50 bp, Homo sapiens
gtacgaatgggaggtcctcgacacctggggaactgcggactatgcggcag

SEQ ID NO: 4154 - DNA, 50 bp, Homo sapiens; identical to SEQ ID NO: 2478

SEQ ID NO: 4155 - DNA, 50 bp, Homo sapiens
tgacctccaccaaagcccatataaggagcggagttgttaaggactgaaga

SEQ ID NO: 4156 - DNA, 50 bp, Homo sapiens
tttctccggactcatcagtaaacctgtagaagtgtcgctttccagccttt

SEQ ID NO: 4157 - DNA, 50 bp, Homo sapiens; identical to SEQ ID NO: 3153

SEQ ID NO: 4158 - DNA, 50 bp, Homo sapiens
aaagttgatactgtgggttatttttgtgaacagcctgatgtttgggacct

SEQ ID NO: 4159 - DNA, 50 bp, Homo sapiens
aacttttacactttttccttccaacacttcttgattggctttgcagaaat

SEQ ID NO: 4160 - DNA, 50 bp, Homo sapiens
acagccaagacttaggttacagggcaacgcactactgttcagctttgaat

SEQ ID NO: 4161 - DNA, 50 bp, Homo sapiens
acgtgtcctgattttgccacaacctggatattgaagctatccaagctttt

SEQ ID NO: 4162 - DNA, 50 bp, Homo sapiens; identical to SEQ ID NO: 2915

SEQ ID NO: 4163 - DNA, 50 bp, Homo sapiens; identical to SEQ ID NO: 923

SEQ ID NO: 4164 - DNA, 50 bp, Homo sapiens
ccaatgacagcctacctattaccaagggctcccctacaactctgaacctt

SEQ ID NO: 4165 - DNA, 50 bp, Homo sapiens
gacaaaccctggagaaatgggagcttggggagaggatgggagtgggcaga

SEQ ID NO: 4166 - DNA, 50 bp, Homo sapiens
gtgtcagtgcccaaaggagggaggttgatggtgcttaacaaacatgaagt

SEQ ID NO: 4167 - DNA, 50 bp, Homo sapiens
tcattgtataaaagctgttatgtgcaacagtgtggagattccttgtctga

SEQ ID NO: 4168 - DNA, 50 bp, Homo sapiens; identical to SEQ ID NO: 4155

SEQ ID NO: 4169 - DNA, 50 bp, Homo sapiens
ttggcttcattacgagagagaaacataacagaggcagtgatggtttcaga

SEQ ID NO: 4170 - DNA, 50 bp, Homo sapiens; identical to SEQ ID NO: 3706

SEQ ID NO: 4171 - DNA, 50 bp, Homo sapiens
agcacattgggagatacatgataaatttctatctgcagttgctatttgca

SEQ ID NO: 4172 - DNA, 50 bp, Homo sapiens
ggcccagcagaagagcctccttcagcagctactgactgaataaccacttt

SEQ ID NO: 4173 - DNA, 50 bp, Human cytomegalovirus
aataatagattagcagaaggaataatccgtgcgaccgagcttgtgcttct

SEQ ID NO: 4174 - DNA, 50 bp, Human cytomegalovirus
acattcaaaagtttgagcgtcttcatgtacgccgttttcggcctcacgag

SEQ ID NO: 4175 - DNA, 50 bp, Human cytomegalovirus
acgaacagaaatctcaaaagacgctgacccgataagtaccgtcacggaga

SEQ ID NO: 4176 - DNA, 50 bp, Human cytomegalovirus
aggaaccagcaagtcaacaaaagactaacaaagaaaaaccatcttggaat

SEQ ID NO: 4177 - DNA, 50 bp, Human cytomegalovirus
ccaacgacacatccacaaaaatcccccatcgactctcacaatcgcatcat

SEQ ID NO: 4178 - DNA, 50 bp, Human cytomegalovirus
cctctggaggcaagagcacccaccctatggtgactagaagcaaggctgac

SEQ ID NO: 4179 - DNA, 50 bp, Human cytomegalovirus
gatgtccgtctacgcgctatcggccatcatcggcatctatctgctctacc

SEQ ID NO: 4180 - DNA, 50 bp, Human cytomegalovirus
ttcgtgggcaccaagtttcgcaagaactacactgtctgctggccgagttt

SEQ ID NO: 4181 - DNA, 50 bp, Human cytomegalovirus
gagatcgacatcgtcatcgaccgacctccgcagcaacccctacccaatcc

SEQ ID NO: 4182 - DNA, 50 bp, Human cytomegalovirus
ctttgagcaggttctcaaggctgtaactaacgtgctgtcgcccgtctttc

SEQ ID NO: 4183 - DNA, 50 bp, Human cytomegalovirus
tcttctgggacgccaacgacatctaccgcatcttcgccgaattggaaggc

SEQ ID NO: 4184 - DNA, 50 bp, Human cytomegalovirus
agagaacaacaaaaccaccacgacgatgaaacaaaacgctcaaccaaaca

SEQ ID NO: 4185 - DNA, 50 bp, Human cytomegalovirus
gagaaaagattgtgcgatctccccctggtttccagcagactcttgccaga

SEQ ID NO: 4186 - DNA, 50 bp, Human cytomegalovirus
catcttctccaccaaccagggtgggttcatgctgcctatctacgagacgg

SEQ ID NO: 4187 - DNA, 50 bp, Homo sapiens
tcccatgttccctttatttgtcttttggttctgctttttgggagattttt

SEQ ID NO: 4188 - DNA, 50 bp, Homo sapiens
tggtgcgcttttgtgtgcggtggaggagttcctaaccctcggcttgtttt

SEQ ID NO: 4189 - DNA, 50 bp, Homo sapiens
gccgttggttggcttaaacttggtttcgtcacttcgggcactttggtttt

SEQ ID NO: 4190 - DNA, 50 bp, Homo sapiens
ctggcctcccctggctctttaagctcccctttggttaaaaactgggtttt

SEQ ID NO: 4191 - DNA, 50 bp, Homo sapiens
aaaaggccaagggtgttgttggggcgtctgtctaatgtggtgggtctttt

SEQ ID NO: 4192 - DNA, 50 bp, Homo sapiens
gctgtaaatctctgtctcatcatccttctcttttgtttccatagcctttt

SEQ ID NO: 4193 - DNA, 50 bp, Homo sapiens
gtgtgtgctggctgagaagccactgtgaattgattcttcttctgaagttt

SEQ ID NO: 4194 - DNA, 50 bp, Homo sapiens
aataagggtgttgccctttgttccctcacataatcgtgaaaggctgcttt

SEQ ID NO: 4195 - DNA, 50 bp, Homo sapiens
ttcctcagtccctgttcataccatctctgcacccacaatcacactgattt

SEQ ID NO: 4196 - DNA, 50 bp, Homo sapiens
gaccacagatatgcactccttacattaacctcagccttgatgtatcattt

SEQ ID NO: 4197 - DNA, 50 bp, Homo sapiens
ccccctgttatgaaaagggttaaacttgaacccacccattttaaaaattt

SEQ ID NO: 4198 - DNA, 50 bp, Homo sapiens
ttatagctaccagaagccaccagggccttagcccagcagtagaaacctct

SEQ ID NO: 4199 - DNA, 50 bp, Homo sapiens
gatcagtagacacacccctcaatgctgcgaagaaaatgaaggccactctt

SEQ ID NO: 4200 - DNA, 50 bp, Homo sapiens
agcagacaatggacaactgtagtttttgaattgacttctatagccatctt

SEQ ID NO: 4201 - DNA, 50 bp, Homo sapiens
tccaccacagtgcatgataattccgacagaacggccttttatttgtacct

SEQ ID NO: 4202 - DNA, 50 bp, Homo sapiens
tgttctctgaactgtctggatgaaccggtcaacggcactcatcatacctt

SEQ ID NO: 4203 - DNA, 50 bp, Homo sapiens
gcttcactctgctttctgtataaagggcagtctgtggtcacgcaagactt

SEQ ID NO: 4204 - DNA, 50 bp, Homo sapiens
agcaaagaccaaattctccttgggaagtgtgggagcaggctgacattatt

SEQ ID NO: 4205 - DNA, 50 bp, Homo sapiens
gtcctttgatagcagaacaagaggctctgtgatcctctggacctcagatt

SEQ ID NO: 4206 - DNA, 50 bp, Homo sapiens
tccacgacatggtacagctcttcactttttcagctttttaaatgtccatt

SEQ ID NO: 4207 - DNA, 50 bp, Homo sapiens
gacaaggcaatgctactgatcacctgaggataatggtgaaggacttttgt

SEQ ID NO: 4208 - DNA, 50 bp, Homo sapiens
tcaatagttgtgaaattcttctcaggctccttaaaccctcgctttgttgt

SEQ ID NO: 4209 - DNA, 50 bp, Homo sapiens
aggcttacgtttatccaaaagcatttcaccttgcacattactgttgttgt

SEQ ID NO: 4210 - DNA, 50 bp, Homo sapiens
acaagcatttagatcataacatggtaaagcctattaccagccaatgttgt

SEQ ID NO: 4211 - DNA, 50 bp, Homo sapiens
tgttttggcatagagctttacttaaaatgctgcttcattttacacattgt

SEQ ID NO: 4212 - DNA, 50 bp, Homo sapiens
tggagctcaattctatgcagttgtgctgatatttcattaagtcactgtgt

SEQ ID NO: 4213 - DNA, 50 bp, Homo sapiens
tttccccttggcctgagtttttataaaatttccattaattggggcagtgt

SEQ ID NO: 4214 - DNA, 50 bp, Homo sapiens
tgcagctaaattcgaagcttttggtctatattgttaattgccattgctgt

SEQ ID NO: 4215 - DNA, 50 bp, Homo sapiens
ggatttggaagatgctttcagaaatatggcataggtttttgtcgaaatgt

SEQ ID NO: 4216 - DNA, 50 bp, Homo sapiens
aaagaaaaattcagcctgaaccctacccttataaaacaggttaattgggt

SEQ ID NO: 4217 - DNA, 50 bp, Homo sapiens
tgtaagtcccatgcccgaatttggagatttgggtttttcttttcaggggt

SEQ ID NO: 4218 - DNA, 50 bp, Homo sapiens
cggattccaaattacttaaagcctttatgggaacacggtagattgtaggt

SEQ ID NO: 4219 - DNA, 50 bp, Homo sapiens
gccttctggcctctgaggcaaaggtcagtgatactgatgggagggtaggt

SEQ ID NO: 4220 - DNA, 50 bp, Homo sapiens
gctcaagatcacctctttgtcatcttgaacaatgtttttctcttctaggt

SEQ ID NO: 4221 - DNA, 50 bp, Homo sapiens
tgtttccacttcatgggatatgactccatcacaatgaaaatgggtccagt

SEQ ID NO: 4222 - DNA, 50 bp, Homo sapiens
ttgtgattgtaaatcatgtatgtacaaatgccatgaaaattaaagccagt

SEQ ID NO: 4223 - DNA, 50 bp, Homo sapiens
tttcccttatgcaccttccagtctttggcaggacatgatttatggacagt

SEQ ID NO: 4224 - DNA, 50 bp, Homo sapiens
tgcactctaccagatttgaacatctagtgaggttcacattcatactaagt

SEQ ID NO: 4225 - DNA, 50 bp, Homo sapiens
tcaactgcagggaatctcctaggaagcggataaatctggcaattggaagt

SEQ ID NO: 4226 - DNA, 50 bp, Homo sapiens
accaccagctatttgtaattccttcttctaaggcatagtgaaaacttgct

SEQ ID NO: 4227 - DNA, 50 bp, Homo sapiens
tcgctttctaactgattccattccaccatgtcagatactcctgggctgct

SEQ ID NO: 4228 - DNA, 50 bp, Homo sapiens
cagcaatgaggggatatttttgatgagctggaatatccaattgaacagct

SEQ ID NO: 4229 - DNA, 50 bp, Homo sapiens
ccccctaagttaaaagctctgtctttttggggtttgccctatgtaaagct

SEQ ID NO: 4230 - DNA, 50 bp, Homo sapiens
gaagcctctactcttgagtctctttcattactggggatgtaaatgttcct

SEQ ID NO: 4231 - DNA, 50 bp, Homo sapiens
acacttgatctcttccttatttctctcagaaaacctgtaggattgtgcct

SEQ ID NO: 4232 - DNA, 50 bp, Homo sapiens
agtagatattttgccggtgtacttggaatacctttcagaagccaaaccct

SEQ ID NO: 4233 - DNA, 50 bp, Homo sapiens
aattccaatcctggtatatagcacctggtattatgggtaccaaaaaccct

SEQ ID NO: 4234 - DNA, 50 bp, Homo sapiens
actgctccaaatatcaaccccatgtaggcaggatgtttgatcttggtact

SEQ ID NO: 4235 - DNA, 50 bp, Homo sapiens
tgttgttggatacgtacttaactggtatgcatcccatgtctttgggtact

SEQ ID NO: 4236 - DNA, 50 bp, Homo sapiens
ttaggattgctcagtttcatcaaggtttgaaggataggcaggctctcact

SEQ ID NO: 4237 - DNA, 50 bp, Homo sapiens
ggccagtctctgtgtgtcttaatcccttgtccttcattaaaagcaaaact

SEQ ID NO: 4238 - DNA, 50 bp, Homo sapiens
gcattcccggtcactccctccctaatctgagcatcactcaagctctttat

SEQ ID NO: 4239 - DNA, 50 bp, Homo sapiens
ctgaatgccaagagcttcaagagtgtgtgtaaataaagccacacctttat

SEQ ID NO: 4240 - DNA, 50 bp, Homo sapiens
cccgaggaggaagacgaatcgttaaacatctgaaagggtcaggtgagtat

SEQ ID NO: 4241 - DNA, 50 bp, Homo sapiens
caaacttgttctgaagacaatttccaaggttgtcagccatgtcaccatat

SEQ ID NO: 4242 - DNA, 50 bp, Homo sapiens
tcaggttcgtgttaaacgctgtatgttaactatgactggaattctgtgat

SEQ ID NO: 4243 - DNA, 50 bp, Homo sapiens
atggagatccagagacgttggttttcaaatggagcaaacagcactgtgat

SEQ ID NO: 4244 - DNA, 50 bp, Homo sapiens
agctttaggctgagggcatggaaactgttacgcttttccttttatgtgat

SEQ ID NO: 4245 - DNA, 50 bp, Homo sapiens
tcactccagaatagaaattagagtataggtaggcagtccaacctctgcat

SEQ ID NO: 4246 - DNA, 50 bp, Homo sapiens
tcagatgccacacttatgagaccctcatccttctgctcactctcttccat

SEQ ID NO: 4247 - DNA, 50 bp, Homo sapiens
ccctgcctttacctctctacttgtagtgttctttcagagcctgctcccat

SEQ ID NO: 4248 - DNA, 50 bp, Homo sapiens
caaaacaagatgtgccagggcctgggggatgggataatttcagagagaat

SEQ ID NO: 4249 - DNA, 50 bp, Homo sapiens
acccaagagggcagcagttgtgtcatccagttcatcttaagaatttcaat

SEQ ID NO: 4250 - DNA, 50 bp, Homo sapiens
ggggtaggaagaggatggaattgagatgtttgagcctcatttacatcaat

SEQ ID NO: 4251 - DNA, 50 bp, Homo sapiens
gctctctgatgctggtggctgttcccccagaatggaagcattgattaaat

SEQ ID NO: 4252 - DNA, 50 bp, Homo sapiens
ggggagaagtgatatggtgaagggaagtggggagtatttgaacacagttg

SEQ ID NO: 4253 - DNA, 50 bp, Homo sapiens
caccatgcctcacttttagcgcagtgtgatcctacacaaattgccctgtg

SEQ ID NO: 4254 - DNA, 50 bp, Homo sapiens
tatggtttttaggctatgcagatattctgttggtttttgagacagctctg

SEQ ID NO: 4255 - DNA, 50 bp, Homo sapiens
ccttcctttctaaggcataagtgcgacgttcgctgctgtgcgtggaactg

SEQ ID NO: 4256 - DNA, 50 bp, Homo sapiens
gagaggaaggcagacaggcagccattttaagagagaagagccagacaatg

SEQ ID NO: 4257 - DNA, 50 bp, Homo sapiens
gttatcaaaggtggaatcggaaacaccaggctcctagtgccacggaaatg

SEQ ID NO: 4258 - DNA, 50 bp, Homo sapiens
aaatgtgcctattgctagagctcctccctctcaacacccagtttccttgg

SEQ ID NO: 4259 - DNA, 50 bp, Homo sapiens
caatcgtcttatctctacagagagaagtggaaaattctttttcaaggggg

SEQ ID NO: 4260 - DNA, 50 bp, Homo sapiens
ctatggaaggcagttggtgggcaaaagtccggtttttacgctttgagggg

SEQ ID NO: 4261 - DNA, 50 bp, Homo sapiens
gtctgatccttagaccgtctcatcacagcaaccctaactgcagagcaggg

SEQ ID NO: 4262 - DNA, 50 bp, Homo sapiens
aatggtaagaaatgccttgtgtgggtggccctccagtccccagtccaggg

SEQ ID NO: 4263 - DNA, 50 bp, Homo sapiens
aacatatccagggaggacaaactctgggctggacaatgtatccacaaggg

SEQ ID NO: 4264 - DNA, 50 bp, Homo sapiens
gcccatggtcctagaattaattcccctaaaaatttttgaaataggggcgg

SEQ ID NO: 4265 - DNA, 50 bp, Homo sapiens
gccaactgcttagaagcccaacacaacccatctggtctcttgaataaagg

SEQ ID NO: 4266 - DNA, 50 bp, Homo sapiens
gagcccttaaaattactgtatctcctctaaagtgtgatttaatggctgcg

SEQ ID NO: 4267 - DNA, 50 bp, Homo sapiens
cttttgctggagactcatcgctttgggaagtgcatttgcttcgtcgtccg

SEQ ID NO: 4268 - DNA, 50 bp, Homo sapiens
cccagttcacagtagagaggtggagcttagtacttcctgctgcccattag

SEQ ID NO: 4269 - DNA, 50 bp, Homo sapiens
ctgggctgtaggtactgctgggtcactgttgctataaatggtcactggag

SEQ ID NO: 4270 - DNA, 50 bp, Homo sapiens
ctttagatgtcccacgtcccttcaagcacatgaaagagctcacactggag

SEQ ID NO: 4271 - DNA, 50 bp, Homo sapiens
gactctggaactcgagcgtgtggctgctgcgccgacagctgaatctagag

SEQ ID NO: 4272 - DNA, 50 bp, Homo sapiens
ccttagagatcgtgacccttcctgcttgcctccctggtgggctctttcag

SEQ ID NO: 4273 - DNA, 50 bp, Homo sapiens
agagtgagaaggcagttccagttttagcacagatttgtttatgtgttcag

SEQ ID NO: 4274 - DNA, 50 bp, Homo sapiens
tctcaagagagaacgccacagcagagagacccaatccgcctaagttgcag

SEQ ID NO: 4275 - DNA, 50 bp, Homo sapiens
aggtttggggaggggtcccagtctgcgatcctttctccctcttcgtgcag

SEQ ID NO: 4276 - DNA, 50 bp, Homo sapiens
cctcagcttccaactctgattccaggacaggatggaaaacctttggacag

SEQ ID NO: 4277 - DNA, 50 bp, Homo sapiens
aatcccttgtaccatgtatacaaatgagacaagtgagcttgacattcaag

SEQ ID NO: 4278 - DNA, 50 bp, Homo sapiens
gctacagcccggaacacaaaagaagacacccatgcaaataccattaaaag

SEQ ID NO: 4279 - DNA, 50 bp, Homo sapiens
attaaccctttattgccctagccagtggggtgggagggagagattgtttc

SEQ ID NO: 4280 - DNA, 50 bp, Homo sapiens
gttatccttaggccaggtctcccacctttgagccggacaaaaccagagtc

SEQ ID NO: 4281 - DNA, 50 bp, Homo sapiens
tgctgctacagttgcaaaacactggagctagagaaaataaagtactgatc

SEQ ID NO: 4282 - DNA, 50 bp, Homo sapiens
cgagagtcttgctgagccaggacttgagtgcctcgaagttttcaatgatc

SEQ ID NO: 4283 - DNA, 50 bp, Homo sapiens
atcaggagagggagataattagttgcttcctccttcacactgtttgaatc

SEQ ID NO: 4284 - DNA, 50 bp, Homo sapiens
ttgccctttcctctcactgccttttatagccaatatcaatgtctctttgc

SEQ ID NO: 4285 - DNA, 50 bp, Homo sapiens
atccctattgccagacacatcattctctccatccagaaagccaactttgc

SEQ ID NO: 4286 - DNA, 50 bp, Homo sapiens
ctctcttcatcttctgattgggattgtgtccagtcctctgcttcttctgc

SEQ ID NO: 4287 - DNA, 50 bp, Homo sapiens
gagggttctagcaacttaatcccattagcatgttagctgaagactactgc

SEQ ID NO: 4288 - DNA, 50 bp, Homo sapiens
gtcccaagggtcagtatattggaggaaagtaaaggagtgaatcagactgc

SEQ ID NO: 4289 - DNA, 50 bp, Homo sapiens
ctggaattactaatgtggaggtgatctgagaactgggaacaaagtagggc

SEQ ID NO: 4290 - DNA, 50 bp, Homo sapiens
tccagggactgacaagagtgagtggtgtcaacctaaagagaaactcaggc

SEQ ID NO: 4291 - DNA, 50 bp, Homo sapiens
cagaactccatagacagcctcactttgtgctcgggggcctgtcccaaggc

SEQ ID NO: 4292 - DNA, 50 bp, Homo sapiens
gcacttctcccggttcatccctctcaagtaatggctcagctaataaaggc

SEQ ID NO: 4293 - DNA, 50 bp, Homo sapiens
tccatctcctttctactgtagcggagactacaagtcccaggatgccccgc

SEQ ID NO: 4294 - DNA, 50 bp, Homo sapiens
ccacattcttgctgtccacatcctgctgggtgaaattgtgttgaagtagc

SEQ ID NO: 4295 - DNA, 50 bp, Homo sapiens
tgactgtcttggtaattttcttccttgttttacttctggaaactgggagc

SEQ ID NO: 4296 - DNA, 50 bp, Homo sapiens
tgactttcaggaatgtcagcattgacctctccttgccactgttactcagc

SEQ ID NO: 4297 - DNA, 50 bp, Homo sapiens
aagtttgtgcagcacattcctgagtgtacgatattgacctgtagcccagc

SEQ ID NO: 4298 - DNA, 50 bp, Homo sapiens; identical to SEQ ID NO: 4297

SEQ ID NO: 4299 - DNA, 50 bp, Homo sapiens
accagacttcaggaagaataaaggtcgccaactcaataaaaccaccaagc

SEQ ID NO: 4300 - DNA, 50 bp, Homo sapiens
acttgccacataaacagttccatcataaaaactcttccccttcttgttcc

SEQ ID NO: 4301 - DNA, 50 bp, Homo sapiens
gcttccttgaaccacccagaaatccactcaaatttggggattgtcattcc

SEQ ID NO: 4302 - DNA, 50 bp, Homo sapiens
gggggtgatgggttaattaaataagtccattcctgggatttgagggggcc

SEQ ID NO: 4303 - DNA, 50 bp, Homo sapiens
atgcccctcgtcctagaattaattcccctaaaaatctttgaaatagggcc

SEQ ID NO: 4304 - DNA, 50 bp, Homo sapiens
tcaaactaagaccagggttgaaaactatggcccagggaccacttccagcc

SEQ ID NO: 4305 - DNA, 50 bp, Homo sapiens
gacgcgcacacaccttgagtgacagcgacctcttctctacaggttttccc

SEQ ID NO: 4306 - DNA, 50 bp, Homo sapiens
atccaagctttaattctgccatctcagaatggtgataaaccatttctccc

SEQ ID NO: 4307 - DNA, 50 bp, Homo sapiens
tacttcattgctattgtaaaccaaaaataaaatttgaagccccctgcccc

SEQ ID NO: 4308 - DNA, 50 bp, Homo sapiens
cttcatcactcaggaaacagaaaaggcttcagaaggagcggccatgcccc

SEQ ID NO: 4309 - DNA, 50 bp, Homo sapiens
agaacccgtattcataaaatttagaccaaaaaggaaggaatcgaaccccc

SEQ ID NO: 4310 - DNA, 50 bp, Homo sapiens
ttttctattttcatctgtcattttcactgcagagcgcacctcccggaccc

SEQ ID NO: 4311 - DNA, 50 bp, Homo sapiens
agactgaaggggttgaaagacccgtagacgctcctttcctcttttagacc

SEQ ID NO: 4312 - DNA, 50 bp, Homo sapiens
ctctgcggccctagagttaatcccatcagccgaggtgaggcacctgttac

SEQ ID NO: 4313 - DNA, 50 bp, Homo sapiens
ccaattccgcagtacagagcattcagcaggtagtggtgaccctgggtgac

SEQ ID NO: 4314 - DNA, 50 bp, Homo sapiens
ggctccagccaccggcagctctgaaagagtttgaagaatttattgttcac

SEQ ID NO: 4315 - DNA, 50 bp, Homo sapiens; identical to SEQ ID NO: 238

SEQ ID NO: 4316 - DNA, 50 bp, Homo sapiens
cactggaacacaacccagccatgaaaaggaagaagctctgactcaggcac

SEQ ID NO: 4317 - DNA, 50 bp, Homo sapiens
catctcatgcgtagcactgatcaatgtgccccagggtgtgtattcgccac

SEQ ID NO: 4318 - DNA, 50 bp, Homo sapiens
caatcagagcgcgagttacaagcgcggtggagtggggaagcgaatgaaac

SEQ ID NO: 4319 - DNA, 50 bp, Homo sapiens
gacattgcacatttttgaacctgtctacagcagcctgggttggtcacaac

SEQ ID NO: 4320 - DNA, 50 bp, Homo sapiens
acactggcagagtccagaaaagcagcagaagaaaaattcagagcaaaaac

SEQ ID NO: 4321 - DNA, 50 bp, Homo sapiens
tttaacgtgcttctgagacagccaccaccgaaaggcacctttagcggtta

SEQ ID NO: 4322 - DNA, 50 bp, Homo sapiens
tcagccaacctgaatctggtatctttacttaaacacagcagttgtagtta

SEQ ID NO: 4323 - DNA, 50 bp, Homo sapiens
aaaaggagacgatgtcaggcaaacactccttaccctgccatttctagtta

SEQ ID NO: 4324 - DNA, 50 bp, Homo sapiens
tcacaatcagtctcagattcccagcagcagagagtgaattgtatgttgta

SEQ ID NO: 4325 - DNA, 50 bp, Homo sapiens
taaagacaatgctatttaagtgcacagttccaggggcgcttgtggctcta

SEQ ID NO: 4326 - DNA, 50 bp, Homo sapiens
gaagaccaagtctacgcctgcaagctctcagaccgggaacatccactcta

SEQ ID NO: 4327 - DNA, 50 bp, Homo sapiens
ctgaagagacagaaagggagacaccaaaactttaatggcagttattccta

SEQ ID NO: 4328 - DNA, 50 bp, Homo sapiens
gccgcccccatgaagccctttcttactgtaagtgctcaagaacaaagata

SEQ ID NO: 4329 - DNA, 50 bp, Homo sapiens
gctagcacgactctgccttgttcctttggagacaattgttatcatcaata

SEQ ID NO: 4330 - DNA, 50 bp, Homo sapiens
attgggaatatagatcatcaacagacacagccctggacgcataaatttga

SEQ ID NO: 4331 - DNA, 50 bp, Homo sapiens
actaacgtatttcatcatggaaggtcctgtggtgatggttttccctggga

SEQ ID NO: 4332 - DNA, 50 bp, Homo sapiens
aagtaatagctccctgtttgtgccttgttagggctagggatgtttaagga

SEQ ID NO: 4333 - DNA, 50 bp, Homo sapiens
agctcctccccttagtgaccccaagtctgtttccctcagctgcataagga

SEQ ID NO: 4334 - DNA, 50 bp, Homo sapiens
ccctcaaatctcccaatctactccagggaaaagacacttcaagtgagaga

SEQ ID NO: 4335 - DNA, 50 bp, Homo sapiens
acatgcaaacagtgacttacttagtgcttctgaaaaatttctgagtcaga

SEQ ID NO: 4336 - DNA, 50 bp, Homo sapiens
aatgcccattggtaagtcaacattgttttccctgaaagtcctgagacaga

SEQ ID NO: 4337 - DNA, 50 bp, Homo sapiens
ccatgtttgctgctgctgttgagtttctgtgctttgggagtataataaga

SEQ ID NO: 4338 - DNA, 50 bp, Homo sapiens
tgtgtttggttgggtgtaatgaggaaaatacctgataaaatgtctgaaga

SEQ ID NO: 4339 - DNA, 50 bp, Homo sapiens
tggataagtgaagacagtaataacattgaagcagtgaaccagtggaaaga

SEQ ID NO: 4340 - DNA, 50 bp, Homo sapiens
agcacaaaaatgttgaagtattaggcccaagctccatgtttggttagtca

SEQ ID NO: 4341 - DNA, 50 bp, Homo sapiens
cgtttaacaataataaaggtgactgcttcatctaaggaatccgagccgca

SEQ ID NO: 4342 - DNA, 50 bp, Homo sapiens
gggcattccaccgaaattcttggggaaatttagtagccttcattttagca

SEQ ID NO: 4343 - DNA, 50 bp, Homo sapiens
tccatgttctgtgcaagaaggagacacattttcagttgaggttcccagca

SEQ ID NO: 4344 - DNA, 50 bp, Homo sapiens
agctcaacactgtggtaggaaaatagccactagaaagaaaataaaaagca

SEQ ID NO: 4345 - DNA, 50 bp, Homo sapiens
gcatctccagggtttagcatcaggacagaggattaagtaaattctttcca

SEQ ID NO: 4346 - DNA, 50 bp, Homo sapiens
gagactacagagccttagcccctttaaagcccttaaagttactacttcca

SEQ ID NO: 4347 - DNA, 50 bp, Homo sapiens
agagcaagtctcagaaataatgctgtatctacactgtcatgtatttgcca

SEQ ID NO: 4348 - DNA, 50 bp, Homo sapiens
tggttctctgatttgtaatgagcacctggatatgtcaattaaaatgccca

SEQ ID NO: 4349 - DNA, 50 bp, Homo sapiens
gcaagactgttcagtattatgttagcattgatataaaaagaagcagacca

SEQ ID NO: 4350 - DNA, 50 bp, Homo sapiens
aatgttcccaaaggccaaatttgttgccaggttttatacgcaggtcacca

SEQ ID NO: 4351 - DNA, 50 bp, Homo sapiens
tgcctattgtgattatcgctatcactacatcccctgactaagggaaacca

SEQ ID NO: 4352 - DNA, 50 bp, Homo sapiens
acaaaattcactgcaggtcggtggaatgatagaatgcattttaaatcaca

SEQ ID NO: 4353 - DNA, 50 bp, Homo sapiens
ggacggttggctgaatggcaacagtgatggaatatttatatttagccaca

SEQ ID NO: 4354 - DNA, 50 bp, Homo sapiens
acattgcacatttaatagctgcaccagacactaagagttcctctcacaca

SEQ ID NO: 4355 - DNA, 50 bp, Homo sapiens
cgcttgtcctgtgagtagctcgtcacctgaggccttgtcgtgaatattaa

SEQ ID NO: 4356 - DNA, 50 bp, Homo sapiens
tggagcaaaccacagtttcatgcccatcgtcctagaattaattcccctaa

SEQ ID NO: 4357 - DNA, 50 bp, Homo sapiens
gggacaacacagtggatttgaaatctgaaggggcattggtggtactggaa

SEQ ID NO: 4358 - DNA, 50 bp, Homo sapiens
acctccatatcttctcgtacttgttcctgctggtctcttagctctccgaa

SEQ ID NO: 4359 - DNA, 50 bp, Homo sapiens
cgaggatggtttcctgatagctttcaaacacctttgccatctcttcgcaa

SEQ ID NO: 4360 - DNA, 50 bp, Homo sapiens
actcctgacagctcatcctgcaaaattaaaatccaaaatttaagtcgcaa

SEQ ID NO: 4361 - DNA, 50 bp, Homo sapiens
gctggatctctgcctaaagtcacggtaggatgagaagtagaaacgagcaa

SEQ ID NO: 4362 - DNA, 50 bp, Homo sapiens
tcagaccataggtgggtgttgtttcttttaagtgtgtgtactgtgtccaa

SEQ ID NO: 4363 - DNA, 50 bp, Homo sapiens
tcatctatgtagcttaatctcatcgacgtttcggttcatttcctgcacaa

SEQ ID NO: 4364 - DNA, 50 bp, Homo sapiens
ttccttttccgctaatcaagagtccagggaggtgggaacagcctcaacaa

SEQ ID NO: 4365 - DNA, 50 bp, Homo sapiens
ccggcagctgtgtttagcccctccagatggaagtttcacttgaatgtaaa

SEQ ID NO: 4366 - DNA, 50 bp, Homo sapiens
acaaaggaatgaagctttatgacagggcacgtgaaatgtttatagtgaaa

SEQ ID NO: 4367 - DNA, 50 bp, Homo sapiens
actaaaggtcacaacccattaacaaccatgaaattggtgttgggaagaaa

SEQ ID NO: 4368 - DNA, 50 bp, Homo sapiens
tgctcaggaaaccaaaaaggatgtctgcatggaggacaaaaaggcacaaa

SEQ ID NO: 4369 - DNA, 50 bp, Homo sapiens
tgagaaccgcgcaccctacccatcggccacgtgaccagtcctttttaaaa

SEQ ID NO: 4370 - DNA, 50 bp, Homo sapiens
gtctttgggtcagtgtcatcattctcttcaagtctggggcttggggaaaa

SEQ ID NO: 4371 - DNA, 50 bp, Homo sapiens
ctccacacaggagaatctcggcgatttacacccacaggctacgcagaaaa

SEQ ID NO: 4372 - DNA, 50 bp, Homo sapiens
gcgctgctcccaaaatctatctgctgtttaatagtttttacctttcaaaa

SEQ ID NO: 4373 - DNA, 50 bp, Homo sapiens
gggttcagggggttttccctttgcccgtttggccctgggtttaataaaaa

SEQ ID NO: 4374 - DNA, 50 bp, Homo sapiens
ccaactcctcacagggcaggctagcgggcaccaggtcgccggggaagtgg

SEQ ID NO: 4375 - DNA, 50 bp, Homo sapiens
cggctgagagcccggtagggcccaggggccaagcgcaggcagaggccgcg

SEQ ID NO: 4376 - DNA, 50 bp, Homo sapiens
cttggggtccagggcacagcggtgccggggacacagcagttccgagggtc

SEQ ID NO: 4377 - DNA, 50 bp, Homo sapiens
agtatggtaattagaaagcatgttagaacatgtggaaaaagggggaaaaa

SEQ ID NO: 4378 - DNA, 50 bp, Homo sapiens
catcagtcctcatcagctgaagtggcttcccaaggatttaaataaatagt

SEQ ID NO: 4379 - DNA, 50 bp, Homo sapiens
agacattgactacagggtaatttctatgattatattatttagaagtatga

SEQ ID NO: 4380 - DNA, 50 bp, Homo sapiens
ccagtgaactgttagcaacaatgcagaagaatctgcatgtaataaactga

SEQ ID NO: 4381 - DNA, 50 bp, Homo sapiens
acttaaatgccttttaatttttgtcgatgtaatagtttaataccagtaaa

SEQ ID NO: 4382 - DNA, 50 bp, Homo sapiens
tttttaattctagcttctttttaaagattatttgggtacctaataaagga

SEQ ID NO: 4383 - DNA, 50 bp, Homo sapiens
caaagcctccacaggagaccccacccagcagcccagcccctacccaggag

SEQ ID NO: 4384 - DNA, 50 bp, Homo sapiens
cgagtgacattggctgacatcacagttgtctgaacctgttgtggctctat

SEQ ID NO: 4385 - DNA, 50 bp, Homo sapiens
tgaattgcttcaaaacctcttccatctcagaagaccagaccctgggaact

SEQ ID NO: 4386 - DNA, 50 bp, Homo sapiens
gctgaagtggcaatagagagagtctgctagaaagacggaagtcaccatct

SEQ ID NO: 4387 - DNA, 50 bp, Homo sapiens
tctactgactatcctagaaatcgctgtcgccttaatccaagcctacgttt

SEQ ID NO: 4388 - DNA, 50 bp, Homo sapiens
gtgtgtgcttagccaaatacagtaactgtgactggcccagggatgttctc

SEQ ID NO: 4389 - DNA, 50 bp, Homo sapiens
gtgagtccaatgtatgctttagaagtaaagacattgaccgtcacagacca

SEQ ID NO: 4390 - DNA, 50 bp, Homo sapiens
ctcaagaaaagacagaagagacagtgatttgggatgagtctactctagga

SEQ ID NO: 4391 - DNA, 50 bp, Homo sapiens
accctatgcccattgtcctgatctgaaaattcttggaaattgttccatgt

SEQ ID NO: 4392 - DNA, 50 bp, Homo sapiens
ttcacagtcttctattgttggaccacttacattgtaccaaatgttttcct

SEQ ID NO: 4393 - DNA, 50 bp, Homo sapiens
attaagcccccgtagcccatcccgcaagttagatacagctatggttaagg

SEQ ID NO: 4394 - DNA, 50 bp, Homo sapiens
ttatattgtagtggtggtatttgctttccgcctgttggctacttcgaccc

SEQ ID NO: 4395 - DNA, 50 bp, Homo sapiens
ttgttctctgtcatgcccacaatccctttctaaggaagactgccctacta

SEQ ID NO: 4396 - DNA, 50 bp, Homo sapiens
actgaggacgaggctgactactactgtcagtcttatgatagcacctatca

SEQ ID NO: 4397 - DNA, 50 bp, Homo sapiens
agatggaggatgaagctgactactactgttactcaacagacagcagtggt

SEQ ID NO: 4398 - DNA, 50 bp, Homo sapiens
catgtcaatgtgtctgttgtcatggcggaggtggacggcacctgctactg

SEQ ID NO: 4399 - DNA, 50 bp, Homo sapiens
gtcaatgtgtctgttgtcatggcggaggtggacggcacctgctactgagc

SEQ ID NO: 4400 - DNA, 50 bp, Homo sapiens
tccaacctccagtttgaggatgaggctgattattactgtgagacctggga

SEQ ID NO: 4401 - DNA, 50 bp, Homo sapiens
gactacaactggcaatcccaactcctgggctagggctttttctacctttt

SEQ ID NO: 4402 - DNA, 50 bp, Homo sapiens
tatttctgtgcgagagttccccctaaacatggcggaggcttcttctacaa

SEQ ID NO: 4403 - DNA, 50 bp, Homo sapiens
tggctaggagaccttgggcagtacctacagtcttgctgtttctgtttcat

SEQ ID NO: 4404 - DNA, 50 bp, Homo sapiens
gtgagctgaacaaatacatcatttaaatctatgctgcactttgagttgct

SEQ ID NO: 4405 - DNA, 50 bp, Homo sapiens
cccgtgtgtttacagcatttccaggtccagagaggttggcagacaagtgc

SEQ ID NO: 4406 - DNA, 50 bp, Homo sapiens
agctgtgggatataagtagtggtcattatgtcttcggaggtggcaccact

SEQ ID NO: 4407 - DNA, 50 bp, Homo sapiens
gccctttgagaaagactttgttcctgaactgctcccttctcttttagggt

SEQ ID NO: 4408 - DNA, 50 bp, Homo sapiens
ggtctggttctagatcagccttttcagtctgccctggcctggtcattaat

SEQ ID NO: 4409 - DNA, 50 bp, Homo sapiens
gaaaaacctggctagagcagagcacaggatgtaaaagggtgggggagaac

SEQ ID NO: 4410 - DNA, 50 bp, Homo sapiens
ggttatctgagcataacagggacagggtgggccacaggatacctctgagg

SEQ ID NO: 4411 - DNA, 50 bp, Homo sapiens
acaagcaggagcacatcgctcttttatgaaagcccttcaacatttaacgt

SEQ ID NO: 4412 - DNA, 50 bp, Homo sapiens
cagggacaccacttatcctgcttccactatagcatgaatcagtgctctct

SEQ ID NO: 4413 - DNA, 50 bp, Homo sapiens
catcgcacacgaatttgaatcatctgctctttggaatcgcctacaccctg

SEQ ID NO: 4414 - DNA, 50 bp, Homo sapiens
tgtatgtaggtgtctgagcttcacaagccttttatagtccattcagcact

SEQ ID NO: 4415 - DNA, 50 bp, Homo sapiens
cgacgacaacggtgtatattattgtgcgaaagatcgggcagatttgactt

SEQ ID NO: 4416 - DNA, 50 bp, Homo sapiens
cggtgagactcagtgaaagccatcagcaaaactacagtaatgcggcacta

SEQ ID NO: 4417 - DNA, 50 bp, Homo sapiens
aagttaaacaagactctgaaagccctaaatcaactagtccgtcggctgca

SEQ ID NO: 4418 - DNA, 50 bp, Homo sapiens
cttgagtggtcctcttctgcctgctgctcatttgtcttgggcaaccattt

SEQ ID NO: 4419 - DNA, 50 bp, Homo sapiens
cccaggaatatacagtacttctgtagtgtccagccattacttagcaaggg

SEQ ID NO: 4420 - DNA, 50 bp, Homo sapiens
tgctctgtctgctggtttgcattgtttctgtctgagttaagagactggca

SEQ ID NO: 4421 - DNA, 50 bp, Homo sapiens
ttcttttctccgttagccacgcagctacctactcccgcttccggttcaaa

SEQ ID NO: 4422 - DNA, 50 bp, Homo sapiens; identical to SEQ ID NO: 846

SEQ ID NO: 4423 - DNA, 50 bp, Homo sapiens
gatgaacagtctgagaggcgaggacacggccttgtttaactgtgcgagtc

SEQ ID NO: 4424 - DNA, 50 bp, Homo sapiens
tactacttgccaggtccaagaacggggcgggtcctgttatcattattaca

SEQ ID NO: 4425 - DNA, 50 bp, Homo sapiens
gctgtgtttttctgtgggtgaaataaaggtttcggagcccgttttagata

SEQ ID NO: 4426 - DNA, 50 bp, Homo sapiens
catttctgtgcgagagtgaagaggggaccctagaggatttcgttgtggga

SEQ ID NO: 4427 - DNA, 50 bp, Homo sapiens
ggactccaggctgaggacgaggctgattattagtgatgctcataaacaag

SEQ ID NO: 4428 - DNA, 50 bp, Homo sapiens
ctcttattgtgcgagagacctcccggaactgccactgaaggtggaggcta

SEQ ID NO: 4429 - DNA, 50 bp, Homo sapiens
ctccctgactatctcgggcctctagcctgaggacgaggctgattattatt

SEQ ID NO: 4430 - DNA, 50 bp, Homo sapiens
aagaactcactgtatctgcaaatgaacagcctgaaaaccgaggacacggc

SEQ ID NO: 4431 - DNA, 50 bp, Homo sapiens
cacggctgtgtttaactctgcgacatgcgggggactatggttcgggggaa

SEQ ID NO: 4432 - DNA, 50 bp, Homo sapiens
tcagggtgattgaaggacacatattgaagtacctagaatgccagaaagtg

SEQ ID NO: 4433 - DNA, 50 bp, Homo sapiens
aacaaaactgtgatttatatcaaataacaatggcttggagggggtatgga

SEQ ID NO: 4434 - DNA, 50 bp, Homo sapiens; identical to SEQ ID NO: 1036

SEQ ID NO: 4435 - DNA, 50 bp, Homo sapiens; identical to SEQ ID NO: 1036

SEQ ID NO: 4436 - DNA, 50 bp, Homo sapiens; identical to SEQ ID NO: 1036

SEQ ID NO: 4437 - DNA, 50 bp, Homo sapiens
tgtggctgtacttaaccttctccaacatacatcctgcattacatgaatgg

SEQ ID NO: 4438 - DNA, 50 bp, Homo sapiens
aagcctttgaagtgcctctgattctatgtaacttgttgcagactggtgtt

SEQ ID NO: 4439 - DNA, 50 bp, Homo sapiens
gcattgacctggaaggagagaagatagagagtggaggctctgaaggagac

SEQ ID NO: 4440 - DNA, 50 bp, Homo sapiens
cagtacagggctggcaagcagtgatctctcaggtatatttatcaataatt

SEQ ID NO: 4441 - DNA, 50 bp, Homo sapiens
caaaccctcctttctgcttgcctcaaacctgccaaatatacccacacttt

SEQ ID NO: 4442 - DNA, 50 bp, Homo sapiens; identical to SEQ ID NO: 562

SEQ ID NO: 4443 - DNA, 50 bp, Homo sapiens
agtgatttgattaactcagggcaaggctgaatatcagagtgtatcgcact

SEQ ID NO: 4444 - DNA, 50 bp, Homo sapiens
gcttccactggaggcttgtattgaccttgtaactatatgttaatctcgtg

SEQ ID NO: 4445 - DNA, 50 bp, Homo sapiens
atgcatgtttaccaaaatggctgtttacagtgcattcagttctgatattt

SEQ ID NO: 4446 - DNA, 50 bp, Homo sapiens
acatgacaggtgtaattagtctgctgagccagctttacccaatgaagggc

SEQ ID NO: 4447 - DNA, 50 bp, Homo sapiens
aacagcaaccaataacggattgtaaagtgtaaaggcacaggttactcatg

SEQ ID NO: 4448 - DNA, 50 bp, Homo sapiens
ccatgccaaggaatggaatttccatcctgagccagttcagttaggtgtca

SEQ ID NO: 4449 - DNA, 50 bp, Homo sapiens
ctagagttcatctctgagctgtaagggtgaccagggggcagggggacgat

SEQ ID NO: 4450 - DNA, 50 bp, Homo sapiens
caagtagacaccagagtcactgtttggttggtgggtgatagtggggtcac

SEQ ID NO: 4451 - DNA, 50 bp, Homo sapiens
tgtcacccttccatgacgcctcctctgtgcatttgagttcactgtttatg

SEQ ID NO: 4452 - DNA, 50 bp, Homo sapiens
ggtaacatgagctatggcagtcggttgtgaaaccacaggaagtgtatggg

SEQ ID NO: 4453 - DNA, 50 bp, Homo sapiens
caaatcgggcaccacctccttcagggcgcatgagaccatattaaattcta

SEQ ID NO: 4454 - DNA, 50 bp, Homo sapiens
cagaactgctttcctatgtttacccaggggacctcctttcagatgaactg

SEQ ID NO: 4455 - DNA, 50 bp, Homo sapiens
agcaataatatctctgttttcatttcagaacattgtgctgtctgtcagca

SEQ ID NO: 4456 - DNA, 50 bp, Homo sapiens
ttacaactacatgatgggcatcgagtttaacccttggatcgggaagtggg

SEQ ID NO: 4457 - DNA, 50 bp, Homo sapiens
aatgtttgagctgaccaagcttctgagattcttaacagaaaaagccatgt

SEQ ID NO: 4458 - DNA, 50 bp, Homo sapiens
acgtcagcttaaaactggaaagaagtcttctggtgtatactgagatttga

SEQ ID NO: 4459 - DNA, 50 bp, Homo sapiens
gcccaaaggagtagctctctgttgttactgttgtgctcttcatggataaa

SEQ ID NO: 4460 - DNA, 50 bp, Homo sapiens
gcaaaaagcccaagagcctgaatttagaccaatctatcatcttcctcctc

SEQ ID NO: 4461 - DNA, 50 bp, Homo sapiens
tggagatgtgataacaactccttatctctttgttggctcatctgaagtgt

SEQ ID NO: 4462 - DNA, 50 bp, Homo sapiens
cttgcagtaaaatgtagcccttcctcctggttgtgcaggagtggccctcg

SEQ ID NO: 4463 - DNA, 50 bp, Homo sapiens
tttctttagcccaagagtggaggctaagctacttacttccaagcctgggt

SEQ ID NO: 4464 - DNA, 50 bp, Homo sapiens
aggcaaagggaacttgaaattagaaaaccccagaaacagtcacaatggct

SEQ ID NO: 4465 - DNA, 50 bp, Homo sapiens
agggtcccttccatagtcctcctgcatcattttcctccaacttgaataaa

SEQ ID NO: 4466 - DNA, 50 bp, Homo sapiens
gccaaccagttcagagtgttcccaaggaattgccacccttactcttcaaa

SEQ ID NO: 4467 - DNA, 50 bp, Homo sapiens
atcccagtctcaaatttcttcatttggaactgatatgtaggccctcatcg

SEQ ID NO: 4468 - DNA, 50 bp, Homo sapiens
tctctcactgttatcatttttgcacaggtggtttcagcagcttgatgcca

SEQ ID NO: 4469 - DNA, 50 bp, Homo sapiens
attgtcatttagactttgaacagctctgggaaatagaagactagggttgt

SEQ ID NO: 4470 - DNA, 50 bp, Homo sapiens; identical to SEQ ID NO: 293

SEQ ID NO: 4471 - DNA, 50 bp, Homo sapiens
ggattcaccgtggccgactcttttccctgctttggtttgtttgaaatcta

SEQ ID NO: 4472 - DNA, 50 bp, Homo sapiens
ccctccacaccatcctccccgatttaaatatagtcactgctacaagtaac

SEQ ID NO: 4473 - DNA, 50 bp, Homo sapiens
ttcatcattgcttgcttgccttcctcccttctgtccgctcttactccctc

SEQ ID NO: 4474 - DNA, 50 bp, Homo sapiens
gcaaactaaccgtgtcaacggggtgagatgttgcatcttataaaattaga

SEQ ID NO: 4475 - DNA, 50 bp, Homo sapiens; identical to SEQ ID NO: 4474

SEQ ID NO: 4476 - DNA, 50 bp, Homo sapiens; identical to SEQ ID NO: 4474

SEQ ID NO: 4477 - DNA, 50 bp, Homo sapiens
agtatctgctttccaggctgaagtgattcattcattattctagtcctgct

SEQ ID NO: 4478 - DNA, 50 bp, Homo sapiens
aagctgtcttctttgttggacaatcagccagaatgataagcaaacctgca

SEQ ID NO: 4479 - DNA, 50 bp, Homo sapiens
ctctcgcggtcgcacgaggatgcttggcacgtaccccctgtacatacttc

SEQ ID NO: 4480 - DNA, 50 bp, Homo sapiens; identical to SEQ ID NO: 4479

SEQ ID NO: 4481 - DNA, 50 bp, Homo sapiens; identical to SEQ ID NO: 4479

SEQ ID NO: 4482 - DNA, 50 bp, Homo sapiens
ctcctgtggattcacatcaaataccagttcagttttgtcattgttctagt

SEQ ID NO: 4483 - DNA, 50 bp, Homo sapiens
ggctcctgattacgatgctttggatgttgccaacaaaattgggatcatct

SEQ ID NO: 4484 - DNA, 50 bp, Homo sapiens
aacgccagcattttgttagaggagttagacttggaaaagttaagggaaga

SEQ ID NO: 4485 - DNA, 50 bp, Homo sapiens
atggggactaagggattaagagtgtgaactaaaaggtaacattttccact

SEQ ID NO: 4486 - DNA, 50 bp, Homo sapiens
actggcgagtatgttctatgttgggcctcctgctgcaaaacaataaacag

SEQ ID NO: 4487 - DNA, 50 bp, Homo sapiens
gctgattaactgtattcccctttcccctatggctgctggtgtaaataaac

SEQ ID NO: 4488 - DNA, 50 bp, Homo sapiens
cccagggtttcatgtctgaggccctcaccaagtgtgagtgacagtataaa

SEQ ID NO: 4489 - DNA, 50 bp, Homo sapiens; identical to SEQ ID NO: 4488

SEQ ID NO: 4490 - DNA, 50 bp, Homo sapiens; identical to SEQ ID NO: 4063

SEQ ID NO: 4491 - DNA, 50 bp, Homo sapiens
acacctctctattttgaagtccctatgtgccctgtaatgtctcgttttaa

SEQ ID NO: 4492 - DNA, 50 bp, Homo sapiens
gggagagctcatgtcagtgaatatagatcattctgttgatacccttcttt

SEQ ID NO: 4493 - DNA, 50 bp, Homo sapiens
ttgaaacttgtaactgagatgctgtagttttttgccatctgtagtgatgt

SEQ ID NO: 4494 - DNA, 50 bp, Homo sapiens
aaagggttttatccactgtcatttcaattggataacattttgtcaagttt

SEQ ID NO: 4495 - DNA, 50 bp, Homo sapiens
tcggaaagaagaagtgggaggatgtgaattttagttctgagtttaccaaa

SEQ ID NO: 4496 - DNA, 50 bp, Homo sapiens
gatcgggaactggctccgttgtgctgaggtcatctttggtcatcagcctc

SEQ ID NO: 4497 - DNA, 50 bp, Homo sapiens
tggtgcttgtgcagcctggcagttcattgtcatctttaataaactaagga

SEQ ID NO: 4498 - DNA, 50 bp, Homo sapiens
agaagtacaagatttcgttcttccttccattaaagtacaatctccctggg

SEQ ID NO: 4499 - DNA, 50 bp, Homo sapiens
tacaagtgaaagctaagatgaacacatttaagttaaatggcagccttgtt

SEQ ID NO: 4500 - DNA, 50 bp, Homo sapiens
aaaaggatgtgacagaagcagagatgaccagaaagcacaggggcagggtt

SEQ ID NO: 4501 - DNA, 50 bp, Homo sapiens
gggttttctataaggggtttcctgctgaacaggggcgtgggattgaatta

SEQ ID NO: 4502 - DNA, 50 bp, Homo sapiens
cctgggaccagggcatattaaaggcttttggcagcaaagtgtcagtgttg

SEQ ID NO: 4503 - DNA, 50 bp, Homo sapiens
tttgtggcttggggctgcctactataaactattgggggttcgtccatttt

SEQ ID NO: 4504 - DNA, 50 bp, Homo sapiens; identical to SEQ ID NO: 746

SEQ ID NO: 4505 - DNA, 50 bp, Homo sapiens
aattcctgaaccgttggatcaccttctgtcagtccatcatctccaccctg

SEQ ID NO: 4506 - DNA, 50 bp, Homo sapiens
cttacgttgggacacctaaattcgccgcgtctgtagaaggcagattcgag

SEQ ID NO: 4507 - DNA, 50 bp, Homo sapiens
aaaaccgtgtctgtcccttcaacagagtcatcgaggaggggtggctgcta

SEQ ID NO: 4508 - DNA, 50 bp, Homo sapiens
aaactgccgggtccccatcttcaaaagagaggaggccctttctccagctt

SEQ ID NO: 4509 - DNA, 50 bp, Homo sapiens
caagaaagcaacttgagccttgggctaatctggctgagtagtcagttata

SEQ ID NO: 4510 - DNA, 50 bp, Homo sapiens
tgtgttctttgagttccccctttacccaaaagtaatttggggaccaaagt

SEQ ID NO: 4511 - DNA, 50 bp, Homo sapiens
gggaaggcaatctgatggggaagttggcaatttctggtttgggtgattta

SEQ ID NO: 4512 - DNA, 50 bp, Homo sapiens
ccagccgtcctcctggggtggaccctagtttaataaagattcaccaagtt

SEQ ID NO: 4513 - DNA, 50 bp, Homo sapiens
catgcaagggcaaaaggcagtgccatgcaagctgtttaaaataaagatgt

SEQ ID NO: 4514 - DNA, 50 bp, Homo sapiens
aggggtgggaggaagcaaaagactctgtacctattttgtatgtgtataat

SEQ ID NO: 4515 - DNA, 50 bp, Homo sapiens
tcaggatgtgagcactcgttgtgtctggatgttacaaatatgggtggttt

SEQ ID NO: 4516 - DNA, 50 bp, Homo sapiens
tgttcacgttgttcacatcccatgtagaaaaacaaagatgccacggagga

SEQ ID NO: 4517 - DNA, 50 bp, Homo sapiens
agccctgcaaaaattcagagtccttgcaaaattgtctaaaatgtcagtgt

SEQ ID NO: 4518 - DNA, 50 bp, Homo sapiens
tgtcatctcaagtcaagtcactggtctgtttgcatttgatacatttttgt

SEQ ID NO: 4519 - DNA, 50 bp, Homo sapiens
gagtgaccacagggatgccacacagctcggatttcagcctctgatgtcag

SEQ ID NO: 4520 - DNA, 50 bp, Homo sapiens
gcctgttgccctttctgtaccatttatttgctcccaatgtttatgataat

SEQ ID NO: 4521 - DNA, 50 bp, Homo sapiens; identical to SEQ ID NO: 4520

SEQ ID NO: 4522 - DNA, 50 bp, Homo sapiens
tcctggatgcctctgaagagagggacagaccgtcagaaactggagagttt

SEQ ID NO: 4523 - DNA, 50 bp, Homo sapiens
acttaaccatataaatgtggaggctatcaacaaagaatgggcttgaaaca

SEQ ID NO: 4524 - DNA, 50 bp, Homo sapiens; identical to SEQ ID NO: 1933

SEQ ID NO: 4525 - DNA, 50 bp, Homo sapiens
aaacagacctaatgctccttgttcctagagtagagtggagggagggtggc

SEQ ID NO: 4526 - DNA, 50 bp, Homo sapiens
gagatagccttgctccggcccccttgaccttcagcaaatcacttctctcc

SEQ ID NO: 4527 - DNA, 50 bp, Homo sapiens
ctgctgcgtctcccttccaaactctggtgctgaataaacccttctgatct

SEQ ID NO: 4528 - DNA, 50 bp, Homo sapiens
cacttggctgcataaatgtggtacaaccattctgtcttgaagggcaggtg

SEQ ID NO: 4529 - DNA, 50 bp, Homo sapiens
cagccaatggacacagtagggcttggtgaatgctgctgagtgaatgagta

SEQ ID NO: 4530 - DNA, 50 bp, Homo sapiens
tgcagaggattgaggcttaattctgagctggccctttccagccaataaat

SEQ ID NO: 4531 - DNA, 50 bp, Homo sapiens
ttgaccttccactagaccatgagcacctgggcggaaagccatatatctta

SEQ ID NO: 4532 - DNA, 50 bp, Homo sapiens
acaagcagacacctgaaacaatcaacgcccaataaaacaaagtaggatga

SEQ ID NO: 4533 - DNA, 50 bp, Homo sapiens
tgaggaagaaagcattttgcatcagcctggagtgaaccatgaacttggat

SEQ ID NO: 4534 - DNA, 50 bp, Homo sapiens
ggaataaggtgttgcctggaatttctggtttgtaaggtggtcactgttct

SEQ ID NO: 4535 - DNA, 50 bp, Homo sapiens
tgaacagatggattaccttttgtcaaagcatcatctcaacactaacttga

SEQ ID NO: 4536 - DNA, 50 bp, Homo sapiens
cccagagttttcagggagtacacaggtagattagtttgaagcattgacct

SEQ ID NO: 4537 - DNA, 50 bp, Homo sapiens; identical to SEQ ID NO: 280

SEQ ID NO: 4538 - DNA, 50 bp, Homo sapiens
ggctgccccagaggacagtgggtggagtggtacctacttattaaatgtct

SEQ ID NO: 4539 - DNA, 50 bp, Homo sapiens
ccgagcaaagatcaaaataaaaagtgacacagcagcttcaccagagcatt

SEQ ID NO: 4540 - DNA, 50 bp, Homo sapiens
tttccttcaagcctagcccttctctcattatttctctctgaccctctccc

SEQ ID NO: 4541 - DNA, 50 bp, Homo sapiens
gggtcagtgttcaagaaggaaagcagttgttgaagctacagaagcccagg

SEQ ID NO: 4542 - DNA, 50 bp, Homo sapiens
tgaagactttccatatcaagagacatggtattgactcaacagtttccagt

SEQ ID NO: 4543 - DNA, 50 bp, Homo sapiens
ggactgtcattcagggaggctaaggagagaggcttgcttgggatatagaa

SEQ ID NO: 4544 - DNA, 50 bp, Homo sapiens
tcacttaaccccaggccattatcatatccagatggtcttcagagttgtct

SEQ ID NO: 4545 - DNA, 50 bp, Homo sapiens
ccactggatggtcatttggcatctccgtatatgtgctctggctcctcagc

SEQ ID NO: 4546 - DNA, 50 bp, Homo sapiens
ctgggccacactgaccctgatacaggcatggcagaagaatgggaatattt

SEQ ID NO: 4547 - DNA, 50 bp, Homo sapiens; identical to SEQ ID NO: 4546

SEQ ID NO: 4548 - DNA, 50 bp, Homo sapiens
tgatagcattggtcttgacaagcaccatagtgacactgaaatggattggt

SEQ ID NO: 4549 - DNA, 50 bp, Homo sapiens
ctgaggatgtagagagaacaggtgggctgtattcacgccattggttggaa

SEQ ID NO: 4550 - DNA, 50 bp, Homo sapiens; identical to SEQ ID NO: 2058

SEQ ID NO: 4551 - DNA, 50 bp, Homo sapiens
tggtccaaaggcaaagttcgggacaagctcaataacttagtcttgtttga

SEQ ID NO: 4552 - DNA, 50 bp, Homo sapiens
caacaggtgtcacactaaggagactttgttcatggctggggacacagccc

SEQ ID NO: 4553 - DNA, 50 bp, Homo sapiens
gcatggaaattcccttcatctggaaccatcagaaacaccctcacactggg

SEQ ID NO: 4554 - DNA, 50 bp, Homo sapiens
ggcagctatggtcaaattgagaaaggtagtgtataaatgtgacaaagaca

SEQ ID NO: 4555 - DNA, 50 bp, Homo sapiens
gctatcttgtctggttttcttgagacctcagatgtgtgttcagcagggct

SEQ ID NO: 4556 - DNA, 50 bp, Homo sapiens
ccgccctgtaccctctttcacctttccctaaagaccctaaatctgaggaa

SEQ ID NO: 4557 - DNA, 50 bp, Homo sapiens
catatgggagaaggccagtgcccaggcatagggttagctcagtttccctc

SEQ ID NO: 4558 - DNA, 50 bp, Homo sapiens
ttaataccaggaacccagcggctctagccactgagcggctaaatgaaata

SEQ ID NO: 4559 - DNA, 50 bp, Homo sapiens
gtggaggggtttaccaccttcctaggtcgttcaaccaggttttgtgagga

SEQ ID NO: 4560 - DNA, 50 bp, Homo sapiens
gcaacccttcagaaaggctttgctcctgctctcagatcagatcaagcatt

SEQ ID NO: 4561 - DNA, 50 bp, Homo sapiens
aacatttggaggaaggtgggaagcagatgactgaggaagggatggactaa

SEQ ID NO: 4562 - DNA, 50 bp, Homo sapiens
tgcccagaaagctcagaaggctaaatgaatattatccctaatacctgcca

SEQ ID NO: 4563 - DNA, 50 bp, Homo sapiens
agaggactcttcgagacattgagaccttctacaacacctccattgaggaa

SEQ ID NO: 4564 - DNA, 50 bp, Homo sapiens; identical to SEQ ID NO: 2128

SEQ ID NO: 4565 - DNA, 50 bp, Homo sapiens
aaactaaaacttcatcttccccaagtgcggggagtacaaggcatggcgta

SEQ ID NO: 4566 - DNA, 50 bp, Homo sapiens
aaaaccttcccataaaatgtaagaaaagctgatgaggctggtgacgttca

SEQ ID NO: 4567 - DNA, 50 bp, Homo sapiens; identical to SEQ ID NO: 641

SEQ ID NO: 4568 - DNA, 50 bp, Homo sapiens
gccacaaaatgttctttgttctttggctccaaaaagactgtcagctttca

SEQ ID NO: 4569 - DNA, 50 bp, Homo sapiens
ctgaggctctccctttctctgtgattggacagttgacagcacccaaactc

SEQ ID NO: 4570 - DNA, 50 bp, Homo sapiens
ccctgtaactcctcactgtactgatttactggcgcatgaaattctattaa

SEQ ID NO: 4571 - DNA, 50 bp, Homo sapiens
cttgagtaaaataaatattgtctttttgtatgtcaagcgggccgccaccg

SEQ ID NO: 4572 - DNA, 50 bp, Homo sapiens
gggagggagggagggaaagcttcctcctaaatcaagcatctttctgttac

SEQ ID NO: 4573 - DNA, 50 bp, Homo sapiens
tcacagatgcatatagacacacatacataatggtactcccaaactgacaa

SEQ ID NO: 4574 - DNA, 50 bp, Homo sapiens
gctgaggactcccgccatgtggccccaggtgccaccaataaaaatcctac

SEQ ID NO: 4575 - DNA, 50 bp, Homo sapiens
caagatgaggatttgggttttctataaggggtttcctgctggacaggggc

SEQ ID NO: 4576 - DNA, 50 bp, Homo sapiens
aaacatggcctttgcttgaaagaaaataccaaggaacaggaaactgatca

SEQ ID NO: 4577 - DNA, 50 bp, Homo sapiens; identical to SEQ ID NO: 52

SEQ ID NO: 4578 - DNA, 50 bp, Homo sapiens
ggaccaaaggctgattcttggagatttaactccccacaggcaatgggttt

SEQ ID NO: 4579 - DNA, 50 bp, Homo sapiens
aatatttgtttaatccccagttcgcctggagccctccgccttcacattcc

SEQ ID NO: 4580 - DNA, 50 bp, Homo sapiens
aaagtaactggttgtcacctatgagacccttacgtgattgttagttaagt

SEQ ID NO: 4581 - DNA, 50 bp, Homo sapiens
ctcagcctcctcatctgggggagtggaatagtatcctccaggtttttcaa

SEQ ID NO: 4582 - DNA, 50 bp, Homo sapiens
ggcaggaggttctcactgttgtgaaggttgtagacgttgtgtaatgtgtt

SEQ ID NO: 4583 - DNA, 50 bp, Homo sapiens
aagtgggaattttctggaagatggtcagctatgaagtaatagagtttgct

SEQ ID NO: 4584 - DNA, 50 bp, Homo sapiens
gcctgtggcccacctggggtcacttggaaaggatctgaataaaggggacc

SEQ ID NO: 4585 - DNA, 50 bp, Homo sapiens
aaataactggctcccagggtggcggtggtggcagcagtgatcctctgaac

SEQ ID NO: 4586 - DNA, 50 bp, Homo sapiens
tgcccacacccacactctccagcatctggcacaataaacattctctgttt

SEQ ID NO: 4587 - DNA, 50 bp, Homo sapiens; identical to SEQ ID NO: 4586

SEQ ID NO: 4588 - DNA, 50 bp, Homo sapiens
gcacccacctttctgcacataagttatggttttccatcttatctgtcttc

SEQ ID NO: 4589 - DNA, 50 bp, Homo sapiens
aattgtcaaacacagcttgcaatatacatagaaacgtctgtgctcaagga

SEQ ID NO: 4590 - DNA, 50 bp, Homo sapiens
tccagaaacatgacaaggaggactttcctgcctcttggagatcagaggag

SEQ ID NO: 4591 - DNA, 50 bp, Homo sapiens
tcatagttaaatttggtattcgtgggggaagaaatgaccatttcccttgt

SEQ ID NO: 4592 - DNA, 50 bp, Homo sapiens
acacacattcttgctctacccaaagctctggctggcagcactaaatgctt

SEQ ID NO: 4593 - DNA, 50 bp, Homo sapiens; identical to SEQ ID NO: 4592

SEQ ID NO: 4594 - DNA, 50 bp, Homo sapiens
gcagtctccacagtcttcagaagacaaatgctcaggtagtcactgtttcc

SEQ ID NO: 4595 - DNA, 50 bp, Homo sapiens
gcctcccgtgcatctgtactcaccctgtacgacaaacacattacattatt

SEQ ID NO: 4596 - DNA, 50 bp, Homo sapiens
tttcctgttccagaaaaggggctgggatgtctccgtctctgtctcaaatt

SEQ ID NO: 4597 - DNA, 50 bp, Homo sapiens
cggccttctccggtgtcctgtaccaactcttctatttaagagaacctcag

SEQ ID NO: 4598 - DNA, 50 bp, Homo sapiens
gggacgttccatgcccaggttaacaaagaactgtgatatatagagtgtct

SEQ ID NO: 4599 - DNA, 50 bp, Homo sapiens
atgggagatgcctgtgtaatttcgtccgaagctgccaggaagaagaacag

SEQ ID NO: 4600 - DNA, 50 bp, Homo sapiens
cctctccattgaaggattcaggaagaagaaaactcaactcagtgccattt

SEQ ID NO: 4601 - DNA, 50 bp, Homo sapiens
cctcaccttggcaccagacacccaggacttatttaaactctgttgcaagt

SEQ ID NO: 4602 - DNA, 50 bp, Homo sapiens
tgcaaatgtgagtttcctctcctgtccgtgtttgtttagtacttttataa

SEQ ID NO: 4603 - DNA, 50 bp, Homo sapiens
agcaggaattggtggcagattttacaaaagatgtatccttccaatttgga

SEQ ID NO: 4604 - DNA, 50 bp, Homo sapiens
tggatctgccaaaaagaactaacacctgtgagaaataaagtgtatcctga

SEQ ID NO: 4605 - DNA, 50 bp, Homo sapiens
ttcctgtactattgtgttttgagtgtgttttggaaccttcatagaacaca

SEQ ID NO: 4606 - DNA, 50 bp, Homo sapiens
tgacccacttaccttgcatctcacaggtagacagtatataactaacaacc

SEQ ID NO: 4607 - DNA, 50 bp, Homo sapiens; identical to SEQ ID NO: 2312

SEQ ID NO: 4608 - DNA, 50 bp, Homo sapiens
cacgagagtgaagagtgagccagcccttctggagcaggagcaggacagaa

SEQ ID NO: 4609 - DNA, 50 bp, Homo sapiens
aagaaaggcacaaaatgtgctatttttggtcacttgctttatgacgttta

SEQ ID NO: 4610 - DNA, 50 bp, Homo sapiens
gtccctggacacagctcttcattccattgacttagaggcaacaggattga

SEQ ID NO: 4611 - DNA, 50 bp, Homo sapiens
gtaccagctctccaacacggaggcaatcgactgcatcacgcagggacgtg

SEQ ID NO: 4612 - DNA, 50 bp, Homo sapiens
gggggctagttctctcctcacttgtaaacttgtgtagtttcacagaaaaa

SEQ ID NO: 4613 - DNA, 50 bp, Homo sapiens
acagaagaatttgtgtggaagcaggatgtaacagatacaccgtaaaggca

SEQ ID NO: 4614 - DNA, 50 bp, Homo sapiens; identical to SEQ ID NO: 2339

SEQ ID NO: 4615 - DNA, 50 bp, Homo sapiens
cttgaaggaagagggaccagggtgggagagctgattgcagaaaggagaga

SEQ ID NO: 4616 - DNA, 50 bp, Homo sapiens
aaaccattaaagtatacagagaggatgacacagccacagaagaaactcat

SEQ ID NO: 4617 - DNA, 50 bp, Homo sapiens
aacatgcacaaagcagttaattaggcagcctggagaaaaccagagatcca

SEQ ID NO: 4618 - DNA, 50 bp, Homo sapiens
acttccagaaactcatcaaatgaacagacaatgtcaaaactactgtgtct

SEQ ID NO: 4619 - DNA, 50 bp, Homo sapiens
gctttatgggtttggcttgtttttcttgcatggtttggagctgatcgctt

SEQ ID NO: 4620 - DNA, 50 bp, Homo sapiens
ttctttcttggcctcaagttcaatatggagaggattgcttccctgaatcc

SEQ ID NO: 4621 - DNA, 50 bp, Homo sapiens
aactatgtggactggattaaggacaccatagctgccaacagctaaagccc

SEQ ID NO: 4622 - DNA, 50 bp, Homo sapiens
cctgacttcttcacgcgggtagccctctacgtggactggatccgttctac

SEQ ID NO: 4623 - DNA, 50 bp, Homo sapiens
agccagcaggacatgaagttgctattaaatggacttcgtgatttttgttt

SEQ ID NO: 4624 - DNA, 50 bp, Homo sapiens; identical to SEQ ID NO: 2383

SEQ ID NO: 4625 - DNA, 50 bp, Homo sapiens
aacttgtgccacaagagttacaatcaaagtggtctccttagactgaattc

SEQ ID NO: 4626 - DNA, 50 bp, Homo sapiens
aaagcctttaaaaacggctgtcaggtttgatctcagtgtaacaacatggc

SEQ ID NO: 4627 - DNA, 50 bp, Homo sapiens
gaaaatgcgccttaggctgagccaacatgactgtcccccaaactccagtg

SEQ ID NO: 4628 - DNA, 50 bp, Homo sapiens
ccagcttcggttccttccacctcatccggctgctctacgacgagtacatg

SEQ ID NO: 4629 - DNA, 50 bp, Homo sapiens
aagattggtgctcctgataaagcaaagggctaggaatacaatggaaagga

SEQ ID NO: 4630 - DNA, 50 bp, Homo sapiens
tcattggtacacattctgtatgctgctgttttcaagttggcaaattaagc

SEQ ID NO: 4631 - DNA, 50 bp, Homo sapiens
tatcagcaactgtcctcatcagtctccataccccttcagctttcctgagc

SEQ ID NO: 4632 - DNA, 50 bp, Homo sapiens
gcagcttggagaaggcgcaatactccagctccaccgttaccgctaatata

SEQ ID NO: 4633 - DNA, 50 bp, Homo sapiens; identical to SEQ ID NO: 4632

SEQ ID NO: 4634 - DNA, 50 bp, Homo sapiens
cggagcctcaaacaagcattataccttctgtgattatgatttcctctcct

SEQ ID NO: 4635 - DNA, 50 bp, Homo sapiens
atgtttcttggggaatatgttagagaattcccttactcttgattgtggga

SEQ ID NO: 4636 - DNA, 50 bp, Homo sapiens
agagtgatagtcttttgcttttggcaaaactctacttaatccaatgggtt

SEQ ID NO: 4637 - DNA, 50 bp, Homo sapiens
gcctcttgcttggcgtgataaccctgtcatcttcccaaagctcatttatg

SEQ ID NO: 4638 - DNA, 50 bp, Homo sapiens
ttcaactgaccagtcgtggttactccctgctgccaggtccttccccttcc

SEQ ID NO: 4639 - DNA, 50 bp, Homo sapiens
ggctggcacctctcaacgtctgtggactgaatgaataaaccctcctcatc

SEQ ID NO: 4640 - DNA, 50 bp, Homo sapiens
tgggaataacgtccaaaacactctggatcttatatggagaatgacattga

SEQ ID NO: 4641 - DNA, 50 bp, Homo sapiens
agtactgaactcagttccatccgtaaaatatgtaaaggtaagtggcagct

SEQ ID NO: 4642 - DNA, 50 bp, Homo sapiens
gcccaacttcatttccatacttcagggaacagcaaattgaggatttactt

SEQ ID NO: 4643 - DNA, 50 bp, Homo sapiens
ccgttgaatgagtgtgttttgtacataacttcagatacttgtgaacatgc

SEQ ID NO: 4644 - DNA, 50 bp, Homo sapiens
tttcttgggagagtcactccagccctgaagtctgtctctagctcctctgt

SEQ ID NO: 4645 - DNA, 50 bp, Homo sapiens; identical to SEQ ID NO: 2514

SEQ ID NO: 4646 - DNA, 50 bp, Homo sapiens
ttaggagtgattactaattatcaagggcacagttgtggtactgtcattga

SEQ ID NO: 4647 - DNA, 50 bp, Homo sapiens
cggacggaaggacggaaaaagctctatttttatgttaggcttatttcatg

SEQ ID NO: 4648 - DNA, 50 bp, Homo sapiens
agtccctgacagcctagaaataagctgtttgtcttctataaagcattgct

SEQ ID NO: 4649 - DNA, 50 bp, Homo sapiens
gcattttctgcctatgctggaatagctccctcttctggtcctggctcagg

SEQ ID NO: 4650 - DNA, 50 bp, Homo sapiens
agtaagggcacgtagagcatttagagttgtctttcagcattcaatcaggc

SEQ ID NO: 4651 - DNA, 50 bp, Homo sapiens
tgggtcttcagccttacccggaaatacttgtggtttctagatcaccatct

SEQ ID NO: 4652 - DNA, 50 bp, Homo sapiens
acaaggctgacaccaacagagatcgtattgatattgccaatgccagagca

SEQ ID NO: 4653 - DNA, 50 bp, Homo sapiens
agctacttctgccttatggctagggaactgtcatgtctaccatgtattgt

SEQ ID NO: 4654 - DNA, 50 bp, Homo sapiens
tgacttgttttgctccatgtctcctcattcctacacctattttctgctgc

SEQ ID NO: 4655 - DNA, 50 bp, Homo sapiens
ctgtgaaaccgtcagttcggaaggctggttagaacatgtgggagcaacat

SEQ ID NO: 4656 - DNA, 50 bp, Homo sapiens
gcctagtgtgtgtgctttcttaatgtgtgtgccaatggtggatctttgct

SEQ ID NO: 4657 - DNA, 50 bp, Homo sapiens
accaaactggactctcgtgcagaaaatgtagcccattaccacatgtagcc

SEQ ID NO: 4658 - DNA, 50 bp, Homo sapiens; identical to SEQ ID NO: 2585

SEQ ID NO: 4659 - DNA, 50 bp, Homo sapiens; identical to SEQ ID NO: 4482

SEQ ID NO: 4660 - DNA, 50 bp, Homo sapiens
gccaacagaacagaagaaaatgtttcagacggttccccaaatgccggttc

SEQ ID NO: 4661 - DNA, 50 bp, Homo sapiens
ctctagaaaggcccaagtccatgagcacagagggtctgatgaagtttgtg

SEQ ID NO: 4662 - DNA, 50 bp, Homo sapiens
agaccaagaggatattcctcaaagcagaaagtgaagaagaaatttttgcg

SEQ ID NO: 4663 - DNA, 50 bp, Homo sapiens
tggagaagttccagtcctgtctgagccctgaagagccagctcccgaatcc

SEQ ID NO: 4664 - DNA, 50 bp, Homo sapiens
gaagtagactttctgtcctcacaccgaagaacccgagtgagcaggaggga

SEQ ID NO: 4665 - DNA, 50 bp, Homo sapiens
gtgggatttctggggaggctggtgaaggagggcagggttcttttctctac

SEQ ID NO: 4666 - DNA, 50 bp, Homo sapiens
ctatagcttcatgaccgtaacatgtgacctgtgtgctggcaggacgactc

SEQ ID NO: 4667 - DNA, 50 bp, Homo sapiens
atgatccccatgttgcaatatggagtctctgccctgagatcttccccatc

SEQ ID NO: 4668 - DNA, 50 bp, Homo sapiens
tggtcagtctttgttctctgagaaattatgttggaagcagcatactttca

SEQ ID NO: 4669 - DNA, 50 bp, Homo sapiens
ccccaagatacacactggaccctctcttgctgaatgtgggcattaatttt

SEQ ID NO: 4670 - DNA, 50 bp, Homo sapiens
ttctaacacgtcgccttcaactgtaatcacaacatcctgactccgtcatt

SEQ ID NO: 4671 - DNA, 50 bp, Homo sapiens
tttttcattttggagctagttactgggagtaagggagggtggggtggggg

SEQ ID NO: 4672 - DNA, 50 bp, Homo sapiens
gggactgtcttttctgtattcgctgttcaataaacattgagtgagcacct

SEQ ID NO: 4673 - DNA, 50 bp, Homo sapiens; identical to SEQ ID NO: 4672

SEQ ID NO: 4674 - DNA, 50 bp, Homo sapiens
agagaagactcatcttcactatcggcacgtccaacaccacgggcgagtcg

SEQ ID NO: 4675 - DNA, 50 bp, Homo sapiens
aaaccgaaatattgaaatggtgtaatgttgtaccatttgcactgtgagca

SEQ ID NO: 4676 - DNA, 50 bp, Homo sapiens
aggtgggggaaaatgaattttgtatgctgaatttctaagcgcctattgtt

SEQ ID NO: 4677 - DNA, 50 bp, Homo sapiens
gtggatgtggagcaggagagctggatcgtggcatttgtttctgggttctg

SEQ ID NO: 4678 - DNA, 50 bp, Homo sapiens; identical to SEQ ID NO: 1767

SEQ ID NO: 4679 - DNA, 50 bp, Homo sapiens
tgtggttgcctctatgtgctgtttttcctcatacaagtaaacacagaaag

SEQ ID NO: 4680 - DNA, 50 bp, Homo sapiens
cccaactgaggaccactgtctacagagtcaggaaatattgtagggagaaa

SEQ ID NO: 4681 - DNA, 50 bp, Homo sapiens
tgtttgtttctttgtgttgactttgtccctggcaaaattttccactctga

SEQ ID NO: 4682 - DNA, 50 bp, Homo sapiens
aggtgacctggttacttagctaggattggtgatttgtactgctttatggt

SEQ ID NO: 4683 - DNA, 50 bp, Homo sapiens
ccctacccttgccctttaacttattgggactgaataaagaatggagaggc

SEQ ID NO: 4684 - DNA, 50 bp, Homo sapiens
gggcttttgctctggtgtattttattgtcagaaagtccagactcaagagt

SEQ ID NO: 4685 - DNA, 50 bp, Homo sapiens
tggtctgactgtgctatggcctcatcatcaagactttcaatcctatccca

SEQ ID NO: 4686 - DNA, 50 bp, Homo sapiens
gggcgaggcaggccgactgtactaaagtaacgcaataaacgcattatcag

SEQ ID NO: 4687 - DNA, 50 bp, Homo sapiens
gtacgccgctacctggacagcgcgatgcaggagaaagagttcaaatacac

SEQ ID NO: 4688 - DNA, 50 bp, Homo sapiens; identical to SEQ ID NO: 2679

SEQ ID NO: 4689 - DNA, 50 bp, Homo sapiens; identical to SEQ ID NO: 844

SEQ ID NO: 4690 - DNA, 50 bp, Homo sapiens
tgagcttgctcttacgttttaagaggtgccaggggtacatttttgcactg

SEQ ID NO: 4691 - DNA, 50 bp, Homo sapiens
actggacaactttgagtactgacatcattgataaataaactggcttgtgg

SEQ ID NO: 4692 - DNA, 50 bp, Homo sapiens
cgcagggtctacgaagaatagggtgaaaaacctcagaagggaaaactcca

SEQ ID NO: 4693 - DNA, 50 bp, Homo sapiens
aggttttgtctggttgcatataatctttgctctttttaagctctgtgagc

SEQ ID NO: 4694 - DNA, 50 bp, Homo sapiens
ccttgcagaccccaccccctgcctgctctctttccctacaactaggtcag

SEQ ID NO: 4695 - DNA, 50 bp, Homo sapiens; identical to SEQ ID NO: 2719

SEQ ID NO: 4696 - DNA, 50 bp, Homo sapiens
ggagttgcactctgggtgggaagcactcaaataaagatgcgtggtgttaa

SEQ ID NO: 4697 - DNA, 50 bp, Homo sapiens
agcttttgaaaagtggaaaggtcattttgttgcatttccccatttcttgt

SEQ ID NO: 4698 - DNA, 50 bp, Homo sapiens
acctccttattgaagggaagagggaccagcacatgaggctgaggctgagg

SEQ ID NO: 4699 - DNA, 50 bp, Homo sapiens
ggtatctcccacacagcctggcactccaaccgtaccctttatgagacctg

SEQ ID NO: 4700 - DNA, 50 bp, Homo sapiens
aaggatggtcacacaccagcactttatacacttctggctcacaggaaagt

SEQ ID NO: 4701 - DNA, 50 bp, Homo sapiens
atcatcctgccagcagcactcctcccgttcctccagcgtagactacattt

SEQ ID NO: 4702 - DNA, 50 bp, Homo sapiens
agtgctacactcgtctccactgtttgttttacttccccaaaatggacctt

SEQ ID NO: 4703 - DNA, 50 bp, Homo sapiens
acgctactattacgacaaaaacatcatccacaagacagcggggaaacgct

SEQ ID NO: 4704 - DNA, 50 bp, Homo sapiens
tttgagagggtaggagggtgggaaggaaacaaccatgtcatttcagaagt

SEQ ID NO: 4705 - DNA, 50 bp, Homo sapiens
catgctcagtatcattgtggagaaccaagagggcctcttaactgtaacaa

SEQ ID NO: 4706 - DNA, 50 bp, Homo sapiens
gaccggcttcccctgtgagcagcagagcagcacaataaatgaggccactg

SEQ ID NO: 4707 - DNA, 50 bp, Homo sapiens
gaagataccaacctgtgtgccatccacgctaagagagtcaccatcatgcc

SEQ ID NO: 4708 - DNA, 50 bp, Homo sapiens
gttatcactctgcctgtgtatagtcagatagtccatgcgaaggctgtata

SEQ ID NO: 4709 - DNA, 50 bp, Homo sapiens; identical to SEQ ID NO: 2764

SEQ ID NO: 4710 - DNA, 50 bp, Homo sapiens
taagccagcactcacaccactaacatgccctgttcagctactcccactcc

SEQ ID NO: 4711 - DNA, 50 bp, Homo sapiens
ggatgttttctagttgtgcatgaatgctggcaacttagtaagttttgaca

SEQ ID NO: 4712 - DNA, 50 bp, Homo sapiens
cccaaatagtaatgctttagagggaggcagtcatatctctgtgtgcagat

SEQ ID NO: 4713 - DNA, 50 bp, Homo sapiens; identical to SEQ ID NO: 2779

SEQ ID NO: 4714 - DNA, 50 bp, Homo sapiens
ccccttcctcacactgacctgtgttccttccctgttctcttttctattaa

SEQ ID NO: 4715 - DNA, 50 bp, Homo sapiens
aaactctaccaaggaggatgcactgggcctgcctgcggaacagggtatgt

SEQ ID NO: 4716 - DNA, 50 bp, Homo sapiens
cccttggcacgtaaacagactactagacttattgtaggttcgtttgagct

SEQ ID NO: 4717 - DNA, 50 bp, Homo sapiens
caaaggccagccagcttgggagcagcagagaaataaacagcatttctgat

SEQ ID NO: 4718 - DNA, 50 bp, Homo sapiens
gtgagatcggtgcgttctcctgatgttttgccgtggcttggggattgtac

SEQ ID NO: 4719 - DNA, 50 bp, Homo sapiens
gaactttcaggaagaagcatgttttattctggacacaatgaaagaaacca

SEQ ID NO: 4720 - DNA, 50 bp, Homo sapiens
ttgggtgtagatttctgacatcaaaacttggacccttggaaaacaaaagt

SEQ ID NO: 4721 - DNA, 50 bp, Homo sapiens
caacccagcttccctctgctgtgccacggctgttgcttcggttatttaaa

SEQ ID NO: 4722 - DNA, 50 bp, Homo sapiens; identical to SEQ ID NO: 2827

SEQ ID NO: 4723 - DNA, 50 bp, Homo sapiens
acatgagcttctacctccagatgtgccagggtgcatctcaataaacttgg

SEQ ID NO: 4724 - DNA, 50 bp, Homo sapiens
actgaaaagacaactggctacaaagaaggatgtcagaatgtaaggaaact

SEQ ID NO: 4725 - DNA, 50 bp, Homo sapiens
aagttgtggctgttcttgggaaaggggtcaccgtgtctgacaaagtgtaa

SEQ ID NO: 4726 - DNA, 50 bp, Homo sapiens
cccctcgccccgtcacaccgttatgcattactctgtgtctactattatgt

SEQ ID NO: 4727 - DNA, 50 bp, Homo sapiens
gctgtgagagcttgtttctgattgtttcattgttcgcttctgtaattctg

SEQ ID NO: 4728 - DNA, 50 bp, Homo sapiens; identical to SEQ ID NO: 2863

SEQ ID NO: 4729 - DNA, 50 bp, Homo sapiens
tgctcagtttttcagctcctctccactctgctttcccaaatggattctgt

SEQ ID NO: 4730 - DNA, 50 bp, Homo sapiens
atattcactaccaaaagaggcaagaaagtctgtacccatccaaggaaaaa

SEQ ID NO: 4731 - DNA, 50 bp, Homo sapiens
gctgcattacctctagaaacctcaaacaagtagaaacttgcctagacaat

SEQ ID NO: 4732 - DNA, 50 bp, Homo sapiens
tccaagtcgaaatcgctgctgaggctgagatgaagaaagaaaagtccaaa

SEQ ID NO: 4733 - DNA, 50 bp, Homo sapiens
catctcctcccagaacgtcacagtgctcagagacaaactggtcaagtgtg

SEQ ID NO: 4734 - DNA, 50 bp, Homo sapiens
tttgtctgcacttgagttcacttgagtttacatttgaaatgtgcatgttt

SEQ ID NO: 4735 - DNA, 50 bp, Homo sapiens
agttccctttatttcacataagcccaaactgatagacagtaacggtgttt

SEQ ID NO: 4736 - DNA, 50 bp, Homo sapiens
ggagagggtgggacccagttttgcgtggttggtttttattaattatctgg

SEQ ID NO: 4737 - DNA, 50 bp, Homo sapiens
cctctttccctctgtctgtgcttgtgttgttgacctcctgatggcttgtc

SEQ ID NO: 4738 - DNA, 50 bp, Homo sapiens
ctgattcttctgtcctcattgtgaacataaccgtgtagttgaaacagtca

SEQ ID NO: 4739 - DNA, 50 bp, Homo sapiens
tttccaatgtctgccacacaaacgtatgtaaatgtatatacccacacaca

SEQ ID NO: 4740 - DNA, 50 bp, Homo sapiens
tcctgagaaacaacacatttttccccatgaacggtgctgttctgaagtct

SEQ ID NO: 4741 - DNA, 50 bp, Homo sapiens
tattgccaccatccaactcattgagtcttatggttcacatcttgtttcct

SEQ ID NO: 4742 - DNA, 50 bp, Homo sapiens
agtcctatggttcacatcttgtttcctatagaaatgtcctgtattctggg

SEQ ID NO: 4743 - DNA, 50 bp, Homo sapiens
aaaccaggaagaaaaggtatttctttaaatccagaacaatggagccagct

SEQ ID NO: 4744 - DNA, 50 bp, Homo sapiens
aagcagttggactttcacagcagcaaggaattatcttcaagcacagagga

SEQ ID NO: 4745 - DNA, 50 bp, Homo sapiens
cttcagtgtagctctctcctcttcaaataaacatgtctgccctcatggtt

SEQ ID NO: 4746 - DNA, 50 bp, Homo sapiens
ttctctcgtgcaaccagtttgcccattctcttcctattacttgctccagg

SEQ ID NO: 4747 - DNA, 50 bp, Homo sapiens
tgctcttcagaagtttcaccctttttaatctctcagccacaaacctcagt

SEQ ID NO: 4748 - DNA, 50 bp, Homo sapiens
acgtttactggtactgctttctaaatactgttttacccgttttctcttgt

SEQ ID NO: 4749 - DNA, 50 bp, Homo sapiens
gacaaccaattcaaatgattgtgctaacttatttcccctagttgacctgt

SEQ ID NO: 4750 - DNA, 50 bp, Homo sapiens
ggccaagcccagcttaatggctcatgacctggaaataaaatttaggacca

SEQ ID NO: 4751 - DNA, 50 bp, Homo sapiens
ctcaagacagtgtttgacgaagcgatccgagcagtcctctgcccgcctcc

SEQ ID NO: 4752 - DNA, 50 bp, Homo sapiens
ctttttcaccaccgtcttcaatgcccatgagcctttccgccggggtacag

SEQ ID NO: 4753 - DNA, 50 bp, Homo sapiens
acatcgtatttgcggccagcctctacacccagtgaatgccccatgtaaaa

SEQ ID NO: 4754 - DNA, 50 bp, Homo sapiens
tattccttttatatcactgtgtttgaatcgagggggaggggtggtaaccg

SEQ ID NO: 4755 - DNA, 50 bp, Homo sapiens
atgggaatagttgcatatgggaatttaaaccaacatgtggctgagccttt

SEQ ID NO: 4756 - DNA, 50 bp, Homo sapiens
ggcctttgaatgtaaagctgcataagctgttaggttttgttttaaaagga

SEQ ID NO: 4757 - DNA, 50 bp, Homo sapiens
cagtttggccttatgctttatgcagacttgagtgtatgcaggatttcatt

SEQ ID NO: 4758 - DNA, 50 bp, Homo sapiens
cagaccaagagcaccacagactacaactgcccagcttcatctaaatactt

SEQ ID NO: 4759 - DNA, 50 bp, Homo sapiens
gtgggtaaggggctcaagctgtgatgctgctggttttatctctagtgaaa

SEQ ID NO: 4760 - DNA, 50 bp, Homo sapiens
accctcccaggttcctgctgagatatttctcacaatcagacaagagccag

SEQ ID NO: 4761 - DNA, 50 bp, Homo sapiens
gggcagagaaggtggagagtaaagacccaacattactaacaatgatacag

SEQ ID NO: 4762 - DNA, 50 bp, Homo sapiens; identical to SEQ ID NO: 3039

SEQ ID NO: 4763 - DNA, 50 bp, Homo sapiens
aacacatttgaggaataggaggtccgggttttccataatgggtaaaatgg

SEQ ID NO: 4764 - DNA, 50 bp, Homo sapiens
gctgttccacctcccttcagactatctttcagccttctgccagcagtaaa

SEQ ID NO: 4765 - DNA, 50 bp, Homo sapiens
actataagtcattttgagtgttggtgttaagcatgaaacaaacagcagct

SEQ ID NO: 4766 - DNA, 50 bp, Homo sapiens
gctattcacagttctggggaacaaccaaaggaggaggaggacaaagggaa

SEQ ID NO: 4767 - DNA, 50 bp, Homo sapiens; identical to SEQ ID NO: 1116

SEQ ID NO: 4768 - DNA, 50 bp, Homo sapiens
ctatccacagaagctggccttcgccgagtgcctgtgcagaggctgtatcg

SEQ ID NO: 4769 - DNA, 50 bp, Homo sapiens
gtcatatagtccatgtctgtgatgtgagccaagtgatatcctgtagtaca

SEQ ID NO: 4770 - DNA, 50 bp, Homo sapiens
tccactgggtgaatcctccctctcagaaccaataaaatagaattgacctt

SEQ ID NO: 4771 - DNA, 50 bp, Homo sapiens
gagtttctctatcgcattggtcaaccaaaagagacgcattccattgggcg

SEQ ID NO: 4772 - DNA, 50 bp, Homo sapiens; identical to SEQ ID NO: 183

SEQ ID NO: 4773 - DNA, 50 bp, Homo sapiens
tgcgaaattgtggactgttggactgtgattctaagtgggggaaataggct

SEQ ID NO: 4774 - DNA, 50 bp, Homo sapiens
gaacctttctgaaaccagtggcagcccaagttagagcccagcattaagtc

SEQ ID NO: 4775 - DNA, 50 bp, Homo sapiens
ccagaatcttctattcccacttcccatttctcaaatcatttgacctgtcg

SEQ ID NO: 4776 - DNA, 50 bp, Homo sapiens
cctcctggctgtggtggtctttattcacggctactatgcctgaactctat

SEQ ID NO: 4777 - DNA, 50 bp, Homo sapiens
gaaattaagcgatacgaatcccagcttcgggatcttgagcggcagtcaga

SEQ ID NO: 4778 - DNA, 50 bp, Homo sapiens
tcacagtgaccactacagagtactaagaagagaagatcaagggcatgaaa

SEQ ID NO: 4779 - DNA, 50 bp, Homo sapiens
tcttaaagccagaaataatggaggagattgtgatggaaacacgccagagg

SEQ ID NO: 4780 - DNA, 50 bp, Homo sapiens
cttttctttgtgcagcggtctggttatcgtctatccccaggggaatccac

SEQ ID NO: 4781 - DNA, 50 bp, Homo sapiens
ccacgttggggtcactactggagtggatggaggcccttcacatttctggg

SEQ ID NO: 4782 - DNA, 50 bp, Homo sapiens
tgacctttcgtgattatccgcaaatgcaaacagtttcagatctaatggtt

SEQ ID NO: 4783 - DNA, 50 bp, Homo sapiens
cagtcatggagaccatcgctgtgggctgcacctgcatcttctgaatcacc

SEQ ID NO: 4784 - DNA, 50 bp, Homo sapiens
aggtttcttcatgagtcattccaagttttctagtccataccacagtgcct

SEQ ID NO: 4785 - DNA, 50 bp, Homo sapiens
gaggtcgtcttaaaccagagagctactgaatataagaactcttgcagtct

SEQ ID NO: 4786 - DNA, 50 bp, Homo sapiens
gcagtctcccaaggacccaccatgcagaagtgtcaataaaccacaagttc

SEQ ID NO: 4787 - DNA, 50 bp, Homo sapiens
ggagggagcctctgtgcagatgtgctttctttacagtggctgtaaaaagt

SEQ ID NO: 4788 - DNA, 50 bp, Homo sapiens
gatgcttttaaagttgtagcttcgtgctttgtacagttttctttctggtt

SEQ ID NO: 4789 - DNA, 50 bp, Homo sapiens
aatatatgcaattctccctcccccagcccttccctgacccctaagttatt

SEQ ID NO: 4790 - DNA, 50 bp, Homo sapiens
aatctgccaggctatgtgacagtaggaaggaatggtttcccctaacaagc

SEQ ID NO: 4791 - DNA, 50 bp, Homo sapiens
agcacatacattgatagatggggtgtgggaccaacaaaccaaattaaaag

SEQ ID NO: 4792 - DNA, 50 bp, Homo sapiens; identical to SEQ ID NO: 3240

SEQ ID NO: 4793 - DNA, 50 bp, Homo sapiens
ttgtggaaactgtttcagcaaaggttcttgtatagagggaatagggaatt

SEQ ID NO: 4794 - DNA, 50 bp, Homo sapiens
gggggaaggaaggcttcagacttgggggaaggggagattattgcaaattg

SEQ ID NO: 4795 - DNA, 50 bp, Homo sapiens
ctatggaggaattgagggcaagcacccaggactgatgaggtcttaacaaa

SEQ ID NO: 4796 - DNA, 50 bp, Homo sapiens
acaccaaacagttaagtccattctctggtactagctacaaattcggtttc

SEQ ID NO: 4797 - DNA, 50 bp, Homo sapiens
tgcacacagggagagaacatgagtctctcttaatttttatctggttgcta

SEQ ID NO: 4798 - DNA, 50 bp, Homo sapiens
ttcaatggaaaatgaggggtttctccccactgatattttacatagagtca

SEQ ID NO: 4799 - DNA, 50 bp, Homo sapiens
gaccacattgccaataaaaggtccctgaattccaaattctggaagcacgt

SEQ ID NO: 4800 - DNA, 50 bp, Homo sapiens
aggcccaaatcacagaataaaggactaagagtggatttgctgacattcca

SEQ ID NO: 4801 - DNA, 50 bp, Homo sapiens
gctgtcctcaaagtatataatgtttcatgtaccaagacccttttcacagt

SEQ ID NO: 4802 - DNA, 50 bp, Homo sapiens
aagggtatttggtctggttcatatggtcaaatattactgccttggtagca

SEQ ID NO: 4803 - DNA, 50 bp, Homo sapiens
ggggtgccaggaaatgctctctgacctatcaataaaggaaaagcagtgat

SEQ ID NO: 4804 - DNA, 50 bp, Homo sapiens
tgggaagggaaatttggggattatttatcctcctggggacagtttgggga

SEQ ID NO: 4805 - DNA, 50 bp, Homo sapiens
gccacaaaagttccctctcactttcagtaaaaataaataaaacagcagca

SEQ ID NO: 4806 - DNA, 50 bp, Homo sapiens; identical to SEQ ID NO: 923

SEQ ID NO: 4807 - DNA, 50 bp, Homo sapiens
gatacccaggaatttcacaggaacagttctttgctgcctttatcctccaa

SEQ ID NO: 4808 - DNA, 50 bp, Homo sapiens
cccaccctgccgcccgcattataaacacaggagaataatcaatagaataa

SEQ ID NO: 4809 - DNA, 50 bp, Homo sapiens
aaaccaggcccttaaacttcagctagacaaccaatatgctgtgcttgaaa

SEQ ID NO: 4810 - DNA, 50 bp, Homo sapiens
ccagatccacagcaggcacatatctctccaagggatgaccagttttatgc

SEQ ID NO: 4811 - DNA, 50 bp, Homo sapiens
ggacttgaagaccaaagactttgaaatttgcgagctgctcatgtgtgagt

SEQ ID NO: 4812 - DNA, 50 bp, Homo sapiens
gaaacggcataaagatgagaaatgagcctatttgttagtgttcgtgctta

SEQ ID NO: 4813 - DNA, 50 bp, Homo sapiens
cctgccctcgcctggaatcagtgttactgcatctgattaaatgtctccag

SEQ ID NO: 4814 - DNA, 50 bp, Homo sapiens; identical to SEQ ID NO: 606

SEQ ID NO: 4815 - DNA, 50 bp, Homo sapiens
cagagttgacggacactgctcccaaaaggtcattactcagaataaatgta

SEQ ID NO: 4816 - DNA, 50 bp, Homo sapiens
gaacctcaggcagcagttgtgaaggctttgggggaactagacattcttct

SEQ ID NO: 4817 - DNA, 50 bp, Homo sapiens
ggactgagaagcaagatatcaatgtagcagaattgcacttgtgcctcacg

SEQ ID NO: 4818 - DNA, 50 bp, Homo sapiens
caatggttgcaccttatgaccttgagggaaagccagttcatttaagagga

SEQ ID NO: 4819 - DNA, 50 bp, Homo sapiens
gggggaggggaggggttcgtacaggagcaataaaggagaaactgaggtac

SEQ ID NO: 4820 - DNA, 50 bp, Homo sapiens; identical to SEQ ID NO: 4819

SEQ ID NO: 4821 - DNA, 50 bp, Homo sapiens
acttcttggaactttaactcctgccagcccttctaagacccacgagcggg

SEQ ID NO: 4822 - DNA, 50 bp, Homo sapiens
tgttccatcagcatcccctttttgggcgaggagaaaatcgcaactttttc

SEQ ID NO: 4823 - DNA, 50 bp, Homo sapiens
cagactattccccacctgcttcccagcttcacaataaacggctgcgtctc

SEQ ID NO: 4824 - DNA, 50 bp, Homo sapiens; identical to SEQ ID NO: 4823

SEQ ID NO: 4825 - DNA, 50 bp, Homo sapiens
gtctgtgggcctcatgggcattgtggtgggcactgtcttcatcatccaag

SEQ ID NO: 4826 - DNA, 50 bp, Homo sapiens
ctccaaacagagcaacaacaagtacgcggccagcagctacctgagcctga

SEQ ID NO: 4827 - DNA, 50 bp, Homo sapiens
ccaaagtcctcactcagaccagtgcccctccagttcagttgtctatgtat

SEQ ID NO: 4828 - DNA, 50 bp, Homo sapiens
tgtcttccaccctcaagaaactcttgaacaagaccaacaagaaggcagcg

SEQ ID NO: 4829 - DNA, 50 bp, Homo sapiens
gcaggaccagaccctccaggaaaggcaagagactcatgaccaggggacag

SEQ ID NO: 4830 - DNA, 50 bp, Homo sapiens; identical to SEQ ID NO: 3444

SEQ ID NO: 4831 - DNA, 50 bp, Homo sapiens
agcttggtgtataccttgcaggcactagtcctttacagatgacaatgctg

SEQ ID NO: 4832 - DNA, 50 bp, Homo sapiens
aggaagagccacctgcaagatggacacgagccacaagctgcactgtgaac

SEQ ID NO: 4833 - DNA, 50 bp, Homo sapiens
gggtgcagcatggctctaacaagagaagagatcacagaaacgtgaggatc

SEQ ID NO: 4834 - DNA, 50 bp, Homo sapiens
tacattctccctttagcaacctgagtaagagactctctgccactgggctg

SEQ ID NO: 4835 - DNA, 50 bp, Homo sapiens
aactcttggcctcagaggaaggaaaagcaactcaacactcatggtcaagt

SEQ ID NO: 4836 - DNA, 50 bp, Homo sapiens
agggaacaagggagcaagggaacaagggacatctgaacatctaatgtgag

SEQ ID NO: 4837 - DNA, 50 bp, Homo sapiens
gtggcccctggacgggtacaataacacactgtactgatgtcacaactttg

SEQ ID NO: 4838 - DNA, 50 bp, Homo sapiens
cccctaccctgccccaattcaatcctgccaataaatcctgtcttatttgt

SEQ ID NO: 4839 - DNA, 50 bp, Homo sapiens
acacggaagtgaagattcctgaggatctaacttgcagttggacactatgt

SEQ ID NO: 4840 - DNA, 50 bp, Homo sapiens
cggtccttttgccatacacagttacagagatcagtcaaatccataccacc

SEQ ID NO: 4841 - DNA, 50 bp, Homo sapiens
atacctgtgaggactggttgtctctcttcggtgcccttgagtctctgaat

SEQ ID NO: 4842 - DNA, 50 bp, Homo sapiens
tcatctacttcaggaatcagaaaggacactctggacttcagccaacaggt

SEQ ID NO: 4843 - DNA, 50 bp, Homo sapiens
tgcttcttgaaatggatttaacaacagccaggagcttcctgtcagtaacc

SEQ ID NO: 4844 - DNA, 50 bp, Homo sapiens
ccctccccactgctgctgagtctgtctgatgttttggttgtgtgaataaa

SEQ ID NO: 4845 - DNA, 50 bp, Homo sapiens
aggaggaactggggaaggtggtcattcaggggaagaaccaggatgcaggg

SEQ ID NO: 4846 - DNA, 50 bp, Homo sapiens
tgggaaagtgtgagttaatattggacacattttatcctgatccacagtgg

SEQ ID NO: 4847 - DNA, 50 bp, Homo sapiens
ttaaaaggagcacattaaaattctcagaggacttggcaagggccgcacag

SEQ ID NO: 4848 - DNA, 50 bp, Homo sapiens
gcacacgccatctgtgtaacttcaggatctgttctgtttcaccatgtaac

SEQ ID NO: 4849 - DNA, 50 bp, Homo sapiens; identical to SEQ ID NO: 3493

SEQ ID NO: 4850 - DNA, 50 bp, Homo sapiens
aagagaaatatatgccctagagctgctccagcacccttggtttctgattt

SEQ ID NO: 4851 - DNA, 50 bp, Homo sapiens
acagacagactcgatgcccacacagcttcactctttgagcaacatggaat

SEQ ID NO: 4852 - DNA, 50 bp, Homo sapiens
gcacggtgtgttgccacgatttgaccctcaacttctagcagtatatcagt

SEQ ID NO: 4853 - DNA, 50 bp, Homo sapiens
agtgtagttactagtcttttgacatggatgattctgaggaggaagctgtt

SEQ ID NO: 4854 - DNA, 50 bp, Homo sapiens
tcactgccatacaggttttccaatacacaagtgctagaaaatacacacaa

SEQ ID NO: 4855 - DNA, 50 bp, Homo sapiens
ttgcttgccctccatgtcttcctaaagagcagaacttggagtttctcctt

SEQ ID NO: 4856 - DNA, 50 bp, Homo sapiens
agaatgagcctgaatgttggtggtttttgaaatcctgacttggaggtaaa

SEQ ID NO: 4857 - DNA, 50 bp, Homo sapiens
cctcggccctgacaaacggggatcttttacctcactttgcactgattaat

SEQ ID NO: 4858 - DNA, 50 bp, Homo sapiens
tggcttggccttctctttggtgatcccacccccagccatttgcattgctg

SEQ ID NO: 4859 - DNA, 50 bp, Homo sapiens
aatgtttctcttcctgtgagacttactaaagcaacttagtggcaaaaagt

SEQ ID NO: 4860 - DNA, 50 bp, Homo sapiens
agtacttgagtagtctcaataggagtgtatttgtagacagcagtttccct

SEQ ID NO: 4861 - DNA, 50 bp, Homo sapiens
accctagatgagctgtcctgctccagtaacattctttttctaaaatcatt

SEQ ID NO: 4862 - DNA, 50 bp, Homo sapiens; identical to SEQ ID NO: 971

SEQ ID NO: 4863 - DNA, 50 bp, Homo sapiens
atttgagttcctgtgtgtccaaaactgaggcaccatgttctttgaaaaca

SEQ ID NO: 4864 - DNA, 50 bp, Homo sapiens; identical to SEQ ID NO: 4863

SEQ ID NO: 4865 - DNA, 50 bp, Homo sapiens; identical to SEQ ID NO: 4863

SEQ ID NO: 4866 - DNA, 50 bp, Homo sapiens
gtccacagcggaccctgctgatgcctccaccatctatgcagttgtagttt

SEQ ID NO: 4867 - DNA, 50 bp, Homo sapiens
caggctcccatatgtaccccatcccccatactcacctctttccattttga

SEQ ID NO: 4868 - DNA, 50 bp, Homo sapiens
gttgtattggcaagagggaggggtgagagctgttggagaactgagaatga

SEQ ID NO: 4869 - DNA, 50 bp, Homo sapiens
gtaccatcctcaccgtagtcatcatcatcgccgcgcagcaccacgagaac

SEQ ID NO: 4870 - DNA, 50 bp, Homo sapiens; identical to SEQ ID NO: 817

SEQ ID NO: 4871 - DNA, 50 bp, Homo sapiens
atcgctgaatatgttgatcagtgatgagttgggcttaatgcaaagatcct

SEQ ID NO: 4872 - DNA, 50 bp, Homo sapiens
aggctatttacttccatgcttctccttttcttactctatagtggcaacat

SEQ ID NO: 4873 - DNA, 50 bp, Homo sapiens
gggacccccacccagtgagtcaacataggctcatgtcaagtttgaaaata

SEQ ID NO: 4874 - DNA, 50 bp, Homo sapiens
tggtgtgatatgaaccagtccattcacattggaaaaactgatggttttaa

SEQ ID NO: 4875 - DNA, 50 bp, Homo sapiens
tttttatcagcgcctcaatctctactcgaagaagaaagagaagaaacgtt

SEQ ID NO: 4876 - DNA, 50 bp, Homo sapiens
cgctgtcgccttaatccaagcctacgttttcacacttctagtaagcctct

SEQ ID NO: 4877 - DNA, 50 bp, Homo sapiens
ctgtcgggctctgaagcgagctggtttagttgtagaagatgctctgtttg

SEQ ID NO: 4878 - DNA, 50 bp, Homo sapiens
agaagcagaatgcagaaggagaatgaatcctttggatactttcaaggaca

SEQ ID NO: 4879 - DNA, 50 bp, Homo sapiens
tctggcacagtccagctcacaacaacatcaagagcagaatttggagactt

SEQ ID NO: 4880 - DNA, 50 bp, Homo sapiens
gggacttgactttctttctggactgtttgtattgaaacaaagtggtgtca

SEQ ID NO: 4881 - DNA, 50 bp, Homo sapiens; identical to SEQ ID NO: 607

SEQ ID NO: 4882 - DNA, 50 bp, Homo sapiens
agactggtgatttggagtagtttacaagattcctcattcagagtgccctc

SEQ ID NO: 4883 - DNA, 50 bp, Homo sapiens
ttgcctcctccaatctgtgttctcaactgtggttgccacctcattaactt

SEQ ID NO: 4884 - DNA, 50 bp, Homo sapiens
tggaacataccacatgtagaaaggttgaactggtttttcagctataatgc

SEQ ID NO: 4885 - DNA, 50 bp, Homo sapiens
tcacttagcctttctggtttcccttcctgtgcattgcccattttctcatg

SEQ ID NO: 4886 - DNA, 50 bp, Homo sapiens
agccaagaggtatatcgatgatggaaattagccacatgtacactacattt

SEQ ID NO: 4887 - DNA, 50 bp, Homo sapiens
cttcaccgccctacttccacctccgcccagcctgtaatgtttatataagc

SEQ ID NO: 4888 - DNA, 50 bp, Homo sapiens
ctttcagagccagtttgtccaaggccagcatcccgtctgggagatgcacc

SEQ ID NO: 4889 - DNA, 50 bp, Homo sapiens
gccgtatattactgtgcgagagggccggagtggttactcggtatggacgt

SEQ ID NO: 4890 - DNA, 50 bp, Homo sapiens
aggcaaaagcgcctcacgcattcttgttccttgtttgcttcttcggtttt

SEQ ID NO: 4891 - DNA, 50 bp, Homo sapiens
ttagaaagaaaagtcttttattagtactgtgtagggaaggctaaagaaat

SEQ ID NO: 4892 - DNA, 50 bp, Homo sapiens
actgtgcgaaacgtactgtattacgatttttggagtggccgaagtagtcc

SEQ ID NO: 4893 - DNA, 50 bp, Homo sapiens
cagaccctggtgatgctggaaacagttcctcggagtggagaggtttacac

SEQ ID NO: 4894 - DNA, 50 bp, Homo sapiens
gtccagcaacagtgcccagggctctgatgagtctctcatcgcttgtaaag

SEQ ID NO: 4895 - DNA, 50 bp, Homo sapiens
gtgtattactgtgcgagagccttccgccatcccggagtacgtccaatatg

SEQ ID NO: 4896 - DNA, 50 bp, Homo sapiens
cccgtccctcaagagtcgagtcaccatatcagtagacaagtccaagaacc

SEQ ID NO: 4897 - DNA, 50 bp, Homo sapiens
ggctccaggctcaggatgaggctgattattactgctgctcatatacaagc

SEQ ID NO: 4898 - DNA, 50 bp, Homo sapiens
ccctcactgtcaccttcccgagaataccctaagaccaataaatacttcag

SEQ ID NO: 4899 - DNA, 50 bp, Homo sapiens
tgaatgacttctatctgggaatcttgacggtgacctggaaggcagatggt

SEQ ID NO: 4900 - DNA, 50 bp, Homo sapiens; identical to SEQ ID NO: 2269

SEQ ID NO: 4901 - DNA, 50 bp, Homo sapiens
agaacagagatgattacacctacgaagtctgagttatggtgtgagttgga

SEQ ID NO: 4902 - DNA, 50 bp, Homo sapiens
ttcatcattgcttgcttgccttcctccctcctgtccgctctcactcactc

SEQ ID NO: 4903 - DNA, 50 bp, Homo sapiens; identical to SEQ ID NO: 2215

SEQ ID NO: 4904 - DNA, 50 bp, Homo sapiens
tgaagaacgaccaaaattatttgaagaactagggaaacagatccaacagt

SEQ ID NO: 4905 - DNA, 50 bp, Homo sapiens
gtctacatacttcccaggcacccagcatggaaataaagcacccaccactg

SEQ ID NO: 4906 - DNA, 50 bp, Homo sapiens
atacttcccaggcacccagcatggaaataaagcacccaccactgccctgg

SEQ ID NO: 4907 - DNA, 50 bp, Homo sapiens
cccaaggcatcaagcccttctccctgcactcaataaaccctcaataaata

SEQ ID NO: 4908 - DNA, 50 bp, Homo sapiens
aaggcagagatcttgacacctaaggagtctagtttagggctttggttgga

SEQ ID NO: 4909 - DNA, 50 bp, Homo sapiens
gttgacattagaagcaggattctctggtactccctcagaaaatagaatgc

SEQ ID NO: 4910 - DNA, 50 bp, Homo sapiens
ttggagcgtttttgtgtttgagatattagctcaggtcaattccaaagagt

SEQ ID NO: 4911 - DNA, 50 bp, Homo sapiens; identical to SEQ ID NO: 389

SEQ ID NO: 4912 - DNA, 50 bp, Homo sapiens; identical to SEQ ID NO: 392

SEQ ID NO: 4913 - DNA, 50 bp, Homo sapiens; identical to SEQ ID NO: 394

SEQ ID NO: 4914 - DNA, 50 bp, Homo sapiens
tctgttaccacctctaaaatattggggtggaataaagctgggttcttgca

SEQ ID NO: 4915 - DNA, 50 bp, Homo sapiens; identical to SEQ ID NO: 402

SEQ ID NO: 4916 - DNA, 50 bp, Homo sapiens; identical to SEQ ID NO: 403

SEQ ID NO: 4917 - DNA, 50 bp, Homo sapiens; identical to SEQ ID NO: 404

SEQ ID NO: 4918 - DNA, 50 bp, Homo sapiens
gggtaggcagcttgcacccagttctcctttatctcaacttattgtcctgg

SEQ ID NO: 4919 - DNA, 50 bp, Homo sapiens
acttggaacagaagaacttcggcaacgagaacactatctcaagcagaaga

SEQ ID NO: 4920 - DNA, 50 bp, Homo sapiens
gcggtgtccctgagtgagggcaaagttgtaataacacttgttctctcctt

SEQ ID NO: 4921 - DNA, 50 bp, Homo sapiens; identical to SEQ ID NO: 407

SEQ ID NO: 4922 - DNA, 50 bp, Homo sapiens; identical to SEQ ID NO: 408

SEQ ID NO: 4923 - DNA, 50 bp, Homo sapiens
ggctagtggtgttcagagaaataccaaaacgtgtttttatcattgctggt

SEQ ID NO: 4924 - DNA, 50 bp, Homo sapiens
agctgcctcaggaggttcttaacatataggaatgtaattatcagattcaa

SEQ ID NO: 4925 - DNA, 50 bp, Homo sapiens
aggaaaccaagccctcacaggaaagaaagcctgattcaagaaaacaaagt

SEQ ID NO: 4926 - DNA, 50 bp, Homo sapiens; identical to SEQ ID NO: 418

SEQ ID NO: 4927 - DNA, 50 bp, Homo sapiens; identical to SEQ ID NO: 419

SEQ ID NO: 4928 - DNA, 50 bp, Homo sapiens
gccattttccctccagaaacaaaaccaagataatttatcctgaacacggt

SEQ ID NO: 4929 - DNA, 50 bp, Homo sapiens; identical to SEQ ID NO: 421

SEQ ID NO: 4930 - DNA, 50 bp, Homo sapiens
aggaccatagggaagagccagccttgccttttcttatatgattttgttta

SEQ ID NO: 4931 - DNA, 50 bp, Homo sapiens; identical to SEQ ID NO: 424

SEQ ID NO: 4932 - DNA, 50 bp, Homo sapiens; identical to SEQ ID NO: 429

SEQ ID NO: 4933 - DNA, 50 bp, Homo sapiens
tcgttctacgttatctcatctccttgttttcagtgtgcttcaataatgca

SEQ ID NO: 4934 - DNA, 50 bp, Homo sapiens; identical to SEQ ID NO: 432

SEQ ID NO: 4935 - DNA, 50 bp, Homo sapiens
tgcacttactcattagtttttagtttgaactctcctgcgaggtctaatgt

SEQ ID NO: 4936 - DNA, 50 bp, Homo sapiens
tggttcttctgatgagcaagggaacaacactgagaatgaggaggaggagt

SEQ ID NO: 4937 - DNA, 50 bp, Homo sapiens
aagcaagagattgtaaaccgggtacagatccaagagatgagagaggaccc

SEQ ID NO: 4938 - DNA, 50 bp, Homo sapiens
cgtctactgcggaaaagtcaggggaaactgccaaacaaaggaaaatgccc

SEQ ID NO: 4939 - DNA, 50 bp, Homo sapiens
gtgtttgacttcactgctgcgaaatgactgtctcctggctagtaggatct

SEQ ID NO: 4940 - DNA, 50 bp, Homo sapiens; identical to SEQ ID NO: 1311

SEQ ID NO: 4941 - DNA, 50 bp, Homo sapiens; identical to SEQ ID NO: 1315

SEQ ID NO: 4942 - DNA, 50 bp, Homo sapiens; identical to SEQ ID NO: 1320

SEQ ID NO: 4943 - DNA, 50 bp, Homo sapiens; identical to SEQ ID NO: 1321

SEQ ID NO: 4944 - DNA, 50 bp, Homo sapiens
atgtctataaatggtgtcataactagagcacgggcgttatgtaagtttct

SEQ ID NO: 4945 - DNA, 50 bp, Homo sapiens; identical to SEQ ID NO: 1340

SEQ ID NO: 4946 - DNA, 50 bp, Homo sapiens
acataggcgaagaaaacatggcattgagtgtgctgagtccagacaaatgt

SEQ ID NO: 4947 - DNA, 50 bp, Homo sapiens; identical to SEQ ID NO: 1350

SEQ ID NO: 4948 - DNA, 50 bp, Homo sapiens; identical to SEQ ID NO: 1352

SEQ ID NO: 4949 - DNA, 50 bp, Homo sapiens; identical to SEQ ID NO: 1353

SEQ ID NO: 4950 - DNA, 50 bp, Homo sapiens; identical to SEQ ID NO: 1355

SEQ ID NO: 4951 - DNA, 50 bp, Homo sapiens; identical to SEQ ID NO: 1358

SEQ ID NO: 4952 - DNA, 50 bp, Homo sapiens; identical to SEQ ID NO: 4468

SEQ ID NO: 4953 - DNA, 50 bp, Homo sapiens
aatcacagcagtaactcccagtaggaaagattctcaaaggaatagttctt

SEQ ID NO: 4954 - DNA, 50 bp, Homo sapiens
cctggccttcaagaagtcgtagtggctattttctttggacaaaagtaaga

SEQ ID NO: 4955 - DNA, 50 bp, Homo sapiens
atagacagacggaggtcctgatatccatgggccaacggcttggattattc

SEQ ID NO: 4956 - DNA, 50 bp, Homo sapiens; identical to SEQ ID NO: 1510

SEQ ID NO: 4957 - DNA, 50 bp, Homo sapiens; identical to SEQ ID NO: 1517

SEQ ID NO: 4958 - DNA, 50 bp, Homo sapiens
gatatcagacagcatcgtctctgcgagcacaaagatctgtttgctgagca

SEQ ID NO: 4959 - DNA, 50 bp, Homo sapiens; identical to SEQ ID NO: 1537

SEQ ID NO: 4960 - DNA, 50 bp, Homo sapiens; identical to SEQ ID NO: 1548

SEQ ID NO: 4961 - DNA, 50 bp, Homo sapiens
aattaacggccatcacacccacgactgacggtgatcaaacaaattcacag

SEQ ID NO: 4962 - DNA, 50 bp, Homo sapiens; identical to SEQ ID NO: 1559

SEQ ID NO: 4963 - DNA, 50 bp, Homo sapiens; identical to SEQ ID NO: 3876

SEQ ID NO: 4964 - DNA, 50 bp, Homo sapiens
ctcatagcatagccagcattcagcacacacaaacctactgcccacatttg

SEQ ID NO: 4965 - DNA, 50 bp, Homo sapiens
cacatttgaaggccaaagggaaaacgggggaagcggaagggttggattgg

SEQ ID NO: 4966 - DNA, 50 bp, Homo sapiens
tacgaccactgagaaacgggccacccggcacacggatcttggaacacaaa

SEQ ID NO: 4967 - DNA, 50 bp, Homo sapiens; identical to SEQ ID NO: 3927

SEQ ID NO: 4968 - DNA, 50 bp, Homo sapiens; identical to SEQ ID NO: 3930

SEQ ID NO: 4969 - DNA, 50 bp, Homo sapiens; identical to SEQ ID NO: 3935

SEQ ID NO: 4970 - DNA, 50 bp, Homo sapiens; identical to SEQ ID NO: 3945

SEQ ID NO: 4971 - DNA, 50 bp, Homo sapiens; identical to SEQ ID NO: 3961

SEQ ID NO: 4972 - DNA, 50 bp, Homo sapiens; identical to SEQ ID NO: 3962

SEQ ID NO: 4973 - DNA, 50 bp, Homo sapiens
gcaggttatcgcaagatgtcttagagtagggttacggttctcagtgacac

SEQ ID NO: 4974 - DNA, 50 bp, Homo sapiens
aaatggctttaccaaacattgtcagtacctttacgtgttagaaggcattt

SEQ ID NO: 4975 - DNA, 50 bp, Homo sapiens; identical to SEQ ID NO: 3966

SEQ ID NO: 4976 - DNA, 50 bp, Homo sapiens
ccctacttgattaaagattgaggtggaattctagatgtggtcattcgtgt

SEQ ID NO: 4977 - DNA, 50 bp, Homo sapiens; identical to SEQ ID NO: 3981

SEQ ID NO: 4978 - DNA, 50 bp, Homo sapiens
agaaatggtacggggaatgtgaataacacgaaatggtatggggaaatgtg

SEQ ID NO: 4979 - DNA, 50 bp, Homo sapiens; identical to SEQ ID NO: 4002

SEQ ID NO: 4980 - DNA, 50 bp, Homo sapiens
tgttcttgtgctgctgttatctatactatttttgttcgtgccttctgact

SEQ ID NO: 4981 - DNA, 50 bp, Homo sapiens
gtctgggtgccaacttgagacaggtggtctaggaaattgcggtaagagcg

SEQ ID NO: 4982 - DNA, 50 bp, Homo sapiens; identical to SEQ ID NO: 4009

SEQ ID NO: 4983 - DNA, 50 bp, Homo sapiens; identical to SEQ ID NO: 4010

SEQ ID NO: 4984 - DNA, 50 bp, Homo sapiens
aggctgattcttggagatttaacaccccacaggcaatgggtttatagaca

SEQ ID NO: 4985 - DNA, 50 bp, Homo sapiens
tctcctttcagttcctttgtaggatttctgggcttgaaggatagtcttca

SEQ ID NO: 4986 - DNA, 50 bp, Homo sapiens; identical to SEQ ID NO: 4031

SEQ ID NO: 4987 - DNA, 50 bp, Homo sapiens
agaatgtcccacttgctgtctcttagaggctgagcttcatttctatgagc

SEQ ID NO: 4988 - DNA, 50 bp, Homo sapiens
caacctctggagagtgcctactgttagaagctgaagggatgtcaaagtca

SEQ ID NO: 4989 - DNA, 50 bp, Homo sapiens; identical to SEQ ID NO: 4041

SEQ ID NO: 4990 - DNA, 50 bp, Homo sapiens
gcctcagtacagagggggctctggaagtgtttgttgactgaataaacgga

SEQ ID NO: 4991 - DNA, 50 bp, Homo sapiens; identical to SEQ ID NO: 4054

SEQ ID NO: 4992 - DNA, 50 bp, Homo sapiens
tgcctaagagcaaagcatcctctgcgacaaaagaaaattactgtagtggc

SEQ ID NO: 4993 - DNA, 50 bp, Homo sapiens; identical to SEQ ID NO: 4057

SEQ ID NO: 4994 - DNA, 50 bp, Homo sapiens
gacatggagcccccggaaaagcgggtctggacaccaagtcgatgtgtgag

SEQ ID NO: 4995 - DNA, 50 bp, Homo sapiens
acagaatcagattttgcaggtgtccaacctatagtggctaagaattatgt

SEQ ID NO: 4996 - DNA, 50 bp, Homo sapiens; identical to SEQ ID NO: 4067

SEQ ID NO: 4997 - DNA, 50 bp, Homo sapiens; identical to SEQ ID NO: 4070

SEQ ID NO: 4998 - DNA, 50 bp, Homo sapiens; identical to SEQ ID NO: 4075

SEQ ID NO: 4999 - DNA, 50 bp, Homo sapiens; identical to SEQ ID NO: 4077

SEQ ID NO: 5000 - DNA, 50 bp, Homo sapiens
tggagatccttctacttggctgctgtattcatgcattatgttggtttgag

SEQ ID NO: 5001 - DNA, 50 bp, Homo sapiens
atttgtaccaaatctttgggattcattggcaaataatttcagtgtggtgt

SEQ ID NO: 5002 - DNA, 50 bp, Homo sapiens
ggttttagcagttctttagcccgtggtatttcagtgttgggtttcatagc

SEQ ID NO: 5003 - DNA, 50 bp, Homo sapiens
gggagccataagaacgactccaaaaagagccccaaaggaggacaaggggg

SEQ ID NO: 5004 - DNA, 50 bp, Homo sapiens
tcagggtcttggatactcaagagaaaggagacttgtggttaatgtttgga

SEQ ID NO: 5005 - DNA, 50 bp, Homo sapiens
tccttagcacacgaaaaagccccttcccctggattcatgtttcttatttc

SEQ ID NO: 5006 - DNA, 50 bp, Homo sapiens
aagcaagtagacaccttcataactatgaatgaagctgctgaagtagtgtt

SEQ ID NO: 5007 - DNA, 50 bp, Homo sapiens
tccattaaagatcgcaaatgttgaggtcctgtagcctgaaaactctctgc

SEQ ID NO: 5008 - DNA, 50 bp, Homo sapiens
ctgattcaaacaggttccaacgtaaaacgttcacacttccaccatttcct

SEQ ID NO: 5009 - DNA, 50 bp, Homo sapiens
tgatgttggtatgcttgccctgttacttatagacagtctttgtcataggc

SEQ ID NO: 5010 - DNA, 50 bp, Homo sapiens
ggtctttgtcccagtagagttcatagtctatttagtgtgcatgtttttcc

SEQ ID NO: 5011 - DNA, 50 bp, Homo sapiens
ttgtgtccaaaagtgttaacgaagactacttaacccaatgattggcgcga

SEQ ID NO: 5012 - DNA, 50 bp, Homo sapiens
atgcgtggatattgagaacttaggtgtctaatggggaggattattgctgt

SEQ ID NO: 5013 - DNA, 50 bp, Homo sapiens
aagcatttccatttcaacgagtttgtcagctttattaatgttgggcaaaa

SEQ ID NO: 5014 - DNA, 50 bp, Homo sapiens
aaacctaccactttaagaagacagcgatgggtaattctttattggcaggt

SEQ ID NO: 5015 - DNA, 50 bp, Homo sapiens
attcagcattagtttctcacatcttcccccaggtatccccaacagaatta

SEQ ID NO: 5016 - DNA, 50 bp, Homo sapiens
acacctctcttagggctccatcaaacagaacttttagactgagtaacgct

SEQ ID NO: 5017 - DNA, 50 bp, Homo sapiens; identical to SEQ ID NO: 4297

SEQ ID NO: 5018 - DNA, 50 bp, Homo sapiens
accatgaacagtgtgttgcttcagactattacaaagagaatggggcaggt

SEQ ID NO: 5019 - DNA, 50 bp, Homo sapiens
tttttgaaaagtatgtttggtagaaattagttgtatgccctcaggacggt

SEQ ID NO: 5020 - DNA, 50 bp, Homo sapiens
gaaattagtgtgaacatgtgggaagcccgatgcatgtgggtcagggatct

SEQ ID NO: 5021 - DNA, 50 bp, Homo sapiens
tccctgggtgataccattcaatgtcttaatgtacttgtggctcagacctg

SEQ ID NO: 5022 - DNA, 50 bp, Homo sapiens
cagacagcacagcctgagggtagcagcagccacccatgttcaggtaagtc

SEQ ID NO: 5023 - DNA, 50 bp, Homo sapiens
gccatgaggtggaggacgtggacctggagctgttcaacatctcggtgcag

SEQ ID NO: 5024 - DNA, 50 bp, Homo sapiens
tctgcacccaaacaaataccttttgagatttcttataggcattcctctcg

SEQ ID NO: 5025 - DNA, 50 bp, Homo sapiens
gaagctctgccgcagcgccaggcacttcctacaccactactacgtccacg

SEQ ID NO: 5026 - DNA, 50 bp, Homo sapiens
cagctcggaccaccgccacctccctttttatttacagatcacccagtaag

SEQ ID NO: 5027 - DNA, 50 bp, Homo sapiens
ggtcccctcctggagactccctcacaaaatctttccccaagctgttcccc

SEQ ID NO: 5028 - DNA, 50 bp, Homo sapiens
tgaatgggcgtttatcttaatgaccagttattgaccaaagtgtactcaga

SEQ ID NO: 5029 - DNA, 50 bp, Homo sapiens
agcctattcctattctctagcctattccttaccacctgtaatcttgacca

SEQ ID NO: 5030 - DNA, 50 bp, Homo sapiens
gcaatgggcggccaactatgaaccctacgtggtggtgccacgagactgtc

SEQ ID NO: 5031 - DNA, 50 bp, Homo sapiens
gcctggagcttggctttgtatccaagtgtatggttgctttgtctaagagg

SEQ ID NO: 5032 - DNA, 50 bp, Homo sapiens; identical to SEQ ID NO: 1495

SEQ ID NO: 5033 - DNA, 50 bp, Homo sapiens
agcctacaagccacctcgccactgtgaacttgtcgtcactcttggatgtc

SEQ ID NO: 5034 - DNA, 50 bp, Homo sapiens
cctgctcacagaccaggaactctacaagctggaccctgaccggcagtacc

SEQ ID NO: 5035 - DNA, 50 bp, Homo sapiens
agcagttccacagtgtttcacactacaggatttaaatattttgctccaga

SEQ ID NO: 5036 - DNA, 50 bp, Homo sapiens
cctttatccacctggattttagggacaaacactgaaaacgaataagtcca

SEQ ID NO: 5037 - DNA, 50 bp, Homo sapiens; identical to SEQ ID NO: 5036

SEQ ID NO: 5038 - DNA, 50 bp, Homo sapiens
cagagaacgaaagtcaagtgcagcgagttgggtggaagctgatagagcaa

SEQ ID NO: 5039 - DNA, 50 bp, Homo sapiens
ccacaaaccattcagatcaggcacttgctgaccctggttcttaaggacac

SEQ ID NO: 5040 - DNA, 50 bp, Homo sapiens
aagaaactatgtagcatagtgtcttaacacctcagtaaagtaagctggcc

SEQ ID NO: 5041 - DNA, 50 bp, Homo sapiens
agcaggagacagcttcctgatctagatgtacaattagagtttaggttgga

SEQ ID NO: 5042 - DNA, 50 bp, Homo sapiens
tggaactagtcacaattgaagttcttcatccagtaggtgttaaacagtgt

SEQ ID NO: 5043 - DNA, 50 bp, Homo sapiens
cccacacaagtgcgccacataaatctgcgagactccacgacaacacaggg

SEQ ID NO: 5044 - DNA, 50 bp, Homo sapiens
gcaaacaagttctaaagttgtggagaaaaagtgatgtggtcaagagttga

SEQ ID NO: 5045 - DNA, 50 bp, Homo sapiens
gcaagaaagagaaacgtaaaaacagatagagattctgcctgtgctttggt

SEQ ID NO: 5046 - DNA, 50 bp, Homo sapiens
gagagttgctggtgtaaaatacgtttgaaatagttgatctacaaaggcca

SEQ ID NO: 5047 - DNA, 50 bp, Homo sapiens
ggttaacgcttctgtgaggaccttctggctcttgagataccctaaatatt

SEQ ID NO: 5048 - DNA, 50 bp, Homo sapiens
actttcattggtaaataagcctgtcttcctatctggatttttggtgtgca

SEQ ID NO: 5049 - DNA, 50 bp, Homo sapiens
cagttatttaaaggctgacaactgccttccagacccgcgctgtattaata

SEQ ID NO: 5050 - DNA, 50 bp, Homo sapiens
tggtgggtacagaaacattgtcacagggatcctggaacagaggaagagtt

SEQ ID NO: 5051 - DNA, 50 bp, Homo sapiens
ttctgacctaataattacgggaaatggaaagtctgggccagcatcaataa

SEQ ID NO: 5052 - DNA, 50 bp, Homo sapiens
tgggtcggcaaagctattataactttgaatgctaacggcatgtttgacct

SEQ ID NO: 5053 - DNA, 50 bp, Homo sapiens
gctgtgtcctttctggcacaatcggggattccattctttagacactggaa

SEQ ID NO: 5054 - DNA, 50 bp, Homo sapiens
ttgacaaagatgacatcgccccaagagccaaaaataaatgggaattgaaa

SEQ ID NO: 5055 - DNA, 50 bp, Homo sapiens
gtaaagatcagaataccaaggccagctaaggcaacgactccctccccaaa

SEQ ID NO: 5056 - DNA, 50 bp, Homo sapiens; identical to SEQ ID NO: 1668

SEQ ID NO: 5057 - DNA, 50 bp, Homo sapiens
atgctggtgtcatgtgacatttgttgagtctcgggcatgttcacggtggg

SEQ ID NO: 5058 - DNA, 50 bp, Homo sapiens
ggaaattgtgccaaaaccatggaaaatattactgtgtgtggggtgtctgt

SEQ ID NO: 5059 - DNA, 50 bp, Homo sapiens
tttgtgtgtgaaatataacattgattgaattgcagttacatttggttagt

SEQ ID NO: 5060 - DNA, 50 bp, Homo sapiens; identical to SEQ ID NO: 1868

SEQ ID NO: 5061 - DNA, 50 bp, Homo sapiens
taaggttaggcaataacttaggggtatattctcttcctgcatcccagtgc

SEQ ID NO: 5062 - DNA, 50 bp, Homo sapiens
taaggtgtttgctgggggatgttgtgtgtattaggggagtgtttcccttg

SEQ ID NO: 5063 - DNA, 50 bp, Homo sapiens; identical to SEQ ID NO: 3550

SEQ ID NO: 5064 - DNA, 50 bp, Homo sapiens; identical to SEQ ID NO: 3567

SEQ ID NO: 5065 - DNA, 50 bp, Homo sapiens
actggtgttggtgcttttgtctgtcataccatagtattttcaaaacttca

SEQ ID NO: 5066 - DNA, 50 bp, Homo sapiens
ccttgagaaacacccatctccacttcctagacaaaccaatgaacattagt

SEQ ID NO: 5067 - DNA, 50 bp, Homo sapiens; identical to SEQ ID NO: 3688

SEQ ID NO: 5068 - DNA, 50 bp, Homo sapiens
ctaagtcattgcaggaacggggctgtgttctctgctgggacaaaacagga

SEQ ID NO: 5069 - DNA, 50 bp, Homo sapiens
gccgttctttatagaacaattcctttctcttctcttgaatgtggcagtca

SEQ ID NO: 5070 - DNA, 50 bp, Homo sapiens
agcctacctccctaccccaagctgtctgttgagagcagtgctgaccccag

SEQ ID NO: 5071 - DNA, 50 bp, Homo sapiens
tttcataaacccactccttcctcttcacccacttgcaatccgcatgcttc

SEQ ID NO: 5072 - DNA, 50 bp, Homo sapiens
caagttggtttagttatgtaacaacctgacatgatggaggaaaacaacct

SEQ ID NO: 5073 - DNA, 50 bp, Homo sapiens
gactcgttacgccgtagtttgtcctatcttgtttatcaaatgaatttcgt

SEQ ID NO: 5074 - DNA, 50 bp, Homo sapiens
agccgcccagctacttaatccctcagtaacatctatctaaatctcccatg

SEQ ID NO: 5075 - DNA, 50 bp, Homo sapiens
tggcctgtgcttttaccacaccgtcaaacccttgatcatttctgtaaaca

SEQ ID NO: 5076 - DNA, 50 bp, Homo sapiens
acattctcatagtccaggggctcaacaactttggccttttccagcaccac

SEQ ID NO: 5077 - DNA, 50 bp, Homo sapiens
tcagcagttgtgccttttctcacagatccagccgtccttctcgctgtcac

SEQ ID NO: 5078 - DNA, 50 bp, Homo sapiens
tgcaagcaataaaatcttgctttaatcagtaaccactgtctgacaggaca

SEQ ID NO: 5079 - DNA, 50 bp, Homo sapiens
ggtcgtagagaagacagcaagggaggggataaaacccaggaaggacttaa

SEQ ID NO: 5080 - DNA, 50 bp, Homo sapiens
ggctcacgatgacaaccgcctacggaaaaactctaattcctaaacatcta

SEQ ID NO: 5081 - DNA, 50 bp, Homo sapiens
gacaagccaggtcagcccagattgccaaagcagcacttgcctacaccagc

SEQ ID NO: 5082 - DNA, 50 bp, Homo sapiens
ggttcccttgaagcagtgccaacctaaatctacctcaggtaagtagttag

SEQ ID NO: 5083 - DNA, 50 bp, Homo sapiens
gctgacagtatggaggctaaaggtgtggaggaaccaggaggagatgagta

SEQ ID NO: 5084 - DNA, 50 bp, Homo sapiens
caagtgtgccgggcaagtttgggaaggtgaagcaatctgtgacttaaata

SEQ ID NO: 5085 - DNA, 51 bp, Homo sapiens
gagctactcaaggggaaaaaagggcatatagtatgctctggtagtaaaagt

SEQ ID NO: 5086 - DNA, 50 bp, Homo sapiens; identical to SEQ ID NO: 4220

SEQ ID NO: 5087 - DNA, 50 bp, Homo sapiens
tggtgataatagagattgtttctgccctgggggtagttcaaggataacac

SEQ ID NO: 5088 - DNA, 50 bp, Homo sapiens
cttcaggtttggcccagcccctccttgaagactccttccatccagtcaag

SEQ ID NO: 5089 - DNA, 50 bp, Homo sapiens
cccaagtgaagtcaaagttactgtgtggttgatagggaacatggctggat

SEQ ID NO: 5090 - DNA, 50 bp, Homo sapiens
acccgcagaccagatggttgaaaggaaaaattaaagccttcttggggatt

SEQ ID NO: 5091 - DNA, 50 bp, Homo sapiens
ggagttagatcaaccttatggggaagggaaaggcagggcttgtgacaatt

SEQ ID NO: 5092 - DNA, 50 bp, Homo sapiens
gatggctgcttggttgctaaacccagacagggtccttccagtgcatctgc

SEQ ID NO: 5093 - DNA, 50 bp, Homo sapiens
catttgtgggtggagggttttgaatgtcctctttccatgtcaggcaaagg

SEQ ID NO: 5094 - DNA, 50 bp, Homo sapiens
ttctatgaaggtttccctggacaagaaactgccagagagcccttagctca

SEQ ID NO: 5095 - DNA, 50 bp, Homo sapiens
tgctgaatgtacctgagtgtatgtatttaaaaggactcacatgggcatca

SEQ ID NO: 5096 - DNA, 50 bp, Homo sapiens
tctcaaccctaatattcattgttccatgagcattgtcaggttttggatgg

SEQ ID NO: 5097 - DNA, 50 bp, Homo sapiens
acaagtggaagaggaagacagaagaatgggtcagggagatgcaaggatgg

SEQ ID NO: 5098 - DNA, 50 bp, Homo sapiens
tccttagggaaaagaagattttcaaacccttcgttagtttcggtagggcc

SEQ ID NO: 5099 - DNA, 50 bp, Homo sapiens
acgcaatttgttcacatacatacacatgcaaatcccaaaagaaggtttta

SEQ ID NO: 5100 - DNA, 50 bp, Homo sapiens
cccagccctctatgtacccgtgtcccagccagcaataaatgccatcttgg

SEQ ID NO: 5101 - DNA, 50 bp, Homo sapiens
agcctggaattctaagcagcagtttcacaatctgtaattgcacgtttctg

SEQ ID NO: 5102 - DNA, 50 bp, Homo sapiens
tggttactcatgtcctcaaagacgactcatgatgctggatatgaagaact

SEQ ID NO: 5103 - DNA, 50 bp, Homo sapiens
aggcaaaagtcatttcttccctatattttgtcatgcttatctcctgtctc

SEQ ID NO: 5104 - DNA, 50 bp, Homo sapiens
gtatgaaggcaagaaaatttcaggggaaaacaagtggttattttctggcc

SEQ ID NO: 5105 - DNA, 50 bp, Homo sapiens
gataccctcttcctaagactcatcgcgtctcttccagcctcctcgcccca

SEQ ID NO: 5106 - DNA, 50 bp, Homo sapiens
tctgtatgctgtggtctcatcaggaacctttctctgcactgcatttttcc

SEQ ID NO: 5107 - DNA, 50 bp, Homo sapiens
agagctggttccagaaggttcggatgagtcctgaatgtttatgtagggca

SEQ ID NO: 5108 - DNA, 50 bp, Homo sapiens
tccttagtctccttcaatttccacacactgaacatgacattttacccttt

SEQ ID NO: 5109 - DNA, 50 bp, Homo sapiens
ttttctgttttctgttttaagaaaatctggaaccgcaaggccgtcccttt

SEQ ID NO: 5110 - DNA, 50 bp, Homo sapiens
ccaaagcctttgttgtttggtggcgaggcccctttttgaatggggttttt

SEQ ID NO: 5111 - DNA, 50 bp, Homo sapiens
tgccgcccccaggattcttttaagaataaaaagaaatgagtgtggacatg

SEQ ID NO: 5112 - DNA, 50 bp, Homo sapiens
cctacgatatccttttcaaataggggtgggtccagcccccttgtgccctg

SEQ ID NO: 5113 - DNA, 50 bp, Homo sapiens
ctgggagaaaggtactttgggttagtggtagggatagggatgaacgggaa

SEQ ID NO: 5114 - DNA, 50 bp, Homo sapiens
agcataatcctaatgaggaactttgtctgaagtctgaggctgagttactt

SEQ ID NO: 5115 - DNA, 50 bp, Homo sapiens
ttttggaacccttagccctgtgcaaatcaaaggatgtgaggggaaaaagg

SEQ ID NO: 5116 - DNA, 50 bp, Homo sapiens
atttcccctacggatgggaccaagaaactgatgagaacggccaagtgttt

SEQ ID NO: 5117 - DNA, 50 bp, Homo sapiens
aacacccgaaaccgtcttctgtggcatttgtcagttgaaaaagaacacct

SEQ ID NO: 5118 - DNA, 50 bp, Homo sapiens
ccagtggctgggatggtgacagtgacatccacagtaaacagatgaaatgt

SEQ ID NO: 5119 - DNA, 50 bp, Homo sapiens
ggatttcagaaacagttgcagatattattgattagctagttggcagtggg

SEQ ID NO: 5120 - DNA, 50 bp, Homo sapiens
cttgttcccaggccagccccacacagtaggcagtcattaaagtttggtga

SEQ ID NO: 5121 - DNA, 50 bp, Homo sapiens
ttttccttcaactcttgcgactttcttggtctgcctgtgtggttttaata

SEQ ID NO: 5122 - DNA, 50 bp, Homo sapiens
ttctgttaatagcaaacattgcctttgagtgctactactaaacctgaggc

SEQ ID NO: 5123 - DNA, 50 bp, Homo sapiens
tctagggatctgcccggctcaaaatcccaggccgttaggctaagttgttc

SEQ ID NO: 5124 - DNA, 50 bp, Homo sapiens
cggacaagggctggcaggtaaatgccttcagtttgttgttaaatagaggc

SEQ ID NO: 5125 - DNA, 50 bp, Homo sapiens
agccttagcccctttaaagcacttaaagttactacttccaaatgtgattt

SEQ ID NO: 5126 - DNA, 50 bp, Homo sapiens
accttgtcattaacagctcactttgattgaacatctactctgtggcggtt

SEQ ID NO: 5127 - DNA, 50 bp, Homo sapiens
tggaacggctatttgccggtttaaaaaccaaaaaccccggtttttccaaa

SEQ ID NO: 5128 - DNA, 50 bp, Homo sapiens
gtaaggcagacgagagaggcggaggtctcacagtgaaccacaggatctgg

SEQ ID NO: 5129 - DNA, 50 bp, Homo sapiens
ttgcctgccatgcccttataagtgccctttaatgtcatagcatgtaaagg

SEQ ID NO: 5130 - DNA, 50 bp, Homo sapiens
gggtttgtgtccccatttagaatctgatgaaacggtgggctttccttctt

SEQ ID NO: 5131 - DNA, 50 bp, Homo sapiens
cagagcctccagaattatgtgaacttgtctcaaaacattctctaaatggc

SEQ ID NO: 5132 - DNA, 50 bp, Homo sapiens
gaaaggacccgagggtttgtatttaaaaagcctcccctgggcctcaaaaa

SEQ ID NO: 5133 - DNA, 50 bp, Homo sapiens; identical to SEQ ID NO: 4265

SEQ ID NO: 5134 - DNA, 50 bp, Homo sapiens
tgtctagaacagactgagagtgacacgcatatttgattgtgaggacagtt

SEQ ID NO: 5135 - DNA, 50 bp, Homo sapiens
gtttggcccccaaagtgtttaggagagctttctccctagatcgccctgtg

SEQ ID NO: 5136 - DNA, 50 bp, Homo sapiens
ccaggagggccagaatttgaaaattccttggggttgttctttttccaaaa

SEQ ID NO: 5137 - DNA, 50 bp, Homo sapiens
cagtttgagcaaaagcctttgaaatccaagacttttccccttggggtgct

SEQ ID NO: 5138 - DNA, 50 bp, Homo sapiens
ccagttggtttttggactccaaagcccaggacccttccaaatcctgcttg

SEQ ID NO: 5139 - DNA, 50 bp, Homo sapiens
aggcctttttcaaagaaaaacccctttggggaaaaagggaaagggcaaaa

SEQ ID NO: 5140 - DNA, 50 bp, Homo sapiens
ttttgcttgctgtcgggagaataaagcagggaacctttatgtagtgaaaa

SEQ ID NO: 5141 - DNA, 50 bp, Homo sapiens
gggtttggcccgattatattaggttgggtgggggaaaaattttatggggg

SEQ ID NO: 5142 - DNA, 50 bp, Homo sapiens
gtgaactggatcttgaggccgtgctggaaaccggaaggtacactgcttgg

SEQ ID NO: 5143 - DNA, 50 bp, Homo sapiens
caaaacttgagataaggttaaaactgtgcccagaggaaaactggtagtct

SEQ ID NO: 5144 - DNA, 50 bp, Homo sapiens
tgcagccagattgttccaaggttgccaattacctagtgggtaaatttccc

SEQ ID NO: 5145 - DNA, 50 bp, Homo sapiens
agtgcttatcatgaaatgtgcttcactggttcagctctgttgtttcctta

SEQ ID NO: 5146 - DNA, 50 bp, Homo sapiens
gttatttgggagacaaatggacgggcaggaagattgatgctccgctgttc

SEQ ID NO: 5147 - DNA, 50 bp, Homo sapiens
agctgaagggcttcaactttgcttggatttttaaatattttccttgcata

SEQ ID NO: 5148 - DNA, 50 bp, Homo sapiens
tgcaggctcattgtgctccttcttctgggtttcaattggatttcagtcct

SEQ ID NO: 5149 - DNA, 50 bp, Homo sapiens
atctctaatgaagcctaggatcagatttgtggcataccaacagcacatgt

SEQ ID NO: 5150 - DNA, 50 bp, Homo sapiens
ccacaagggttagtttgggccttaaaactgccaaggagtttccaaggatt

SEQ ID NO: 5151 - DNA, 50 bp, Homo sapiens
cgctttattcccacgaaacctaggacagtggccatcaaaccgagcgcttt

SEQ ID NO: 5152 - DNA, 50 bp, Homo sapiens
cctgttgtggctggctgcataataatttccaggaggctttcggaaatgtt

SEQ ID NO: 5153 - DNA, 50 bp, Homo sapiens
cggtccagtcggctgcttccattccctgaagaagaggccctaaagttaaa

SEQ ID NO: 5154 - DNA, 50 bp, Homo sapiens
ttagcctcaaaggggtggggaaaagcccatacctcctgggccagtcctag

SEQ ID NO: 5155 - DNA, 50 bp, Homo sapiens
ccttagaattaagttgaattttcctgccttgctaagcaagacttcctgca

SEQ ID NO: 5156 - DNA, 50 bp, Homo sapiens
cagccacggcccctcgcgtcttcgcggcacgttaattaaatgcggaaaac

SEQ ID NO: 5157 - DNA, 50 bp, Homo sapiens
ttttacccaaattttaaaggccggataaaagggtttttgtttggaaggga

SEQ ID NO: 5158 - DNA, 50 bp, Homo sapiens
ggaggttagggcctgaagctcaaagctccccctttttaatagtttttccc

SEQ ID NO: 5159 - DNA, 50 bp, Homo sapiens
cccctttgggccccccgggttttccctttttggtttcgggttgttttttg

SEQ ID NO: 5160 - DNA, 50 bp, Homo sapiens
acgtgggcctttggaccccttataagatggtcataagaccccaaaactga

SEQ ID NO: 5161 - DNA, 50 bp, Homo sapiens
atggctataaggccaaaaaagtttggcggcatgggggattttttgctctt

SEQ ID NO: 5162 - DNA, 50 bp, Homo sapiens
agagacggccacctgagaccaattagaatatccacaccagtggaagagag

SEQ ID NO: 5163 - DNA, 50 bp, Homo sapiens
gcctccccaacccctggcctcaatttccctttctataaaatggaagatgt

SEQ ID NO: 5164 - DNA, 50 bp, Homo sapiens
acacccagccaaagaaaagcatacctgaatccaagagagtatttacactg

SEQ ID NO: 5165 - DNA, 50 bp, Homo sapiens
ctcagagaagaacagtgtagaaacccgcgctgtgtgaagcgaggttgggc

SEQ ID NO: 5166 - DNA, 50 bp, Homo sapiens
actttccattgttgagctggggagttggattttgtccatttgtttttatg

SEQ ID NO: 5167 - DNA, 50 bp, Homo sapiens
tcccagtgatgattcgctccctttgttaattactcagtgtttcttgtttt

SEQ ID NO: 5168 - DNA, 50 bp, Homo sapiens
tgcgtgctgctaatacttaggtacccataataggtctttacactcagttt

SEQ ID NO: 5169 - DNA, 50 bp, Homo sapiens
cctgaccttgaggcatttttgattgtgcagttacctagggtatgcttgtg

SEQ ID NO: 5170 - DNA, 50 bp, Homo sapiens
gaggactgggaccgtgattccactaaccggaaaccgtcgcctttcgggcc

SEQ ID NO: 5171 - DNA, 50 bp, Homo sapiens
ggggaagtcaaggagacacacacgctctttcaacagaatcagctcttaat

SEQ ID NO: 5172 - DNA, 50 bp, Homo sapiens
aactagatcctgccttagaaaaccttttgccatgaatgacaaattcatgt

SEQ ID NO: 5173 - DNA, 50 bp, Homo sapiens
tgtcagcatctggaatagtgtaagtatgcagtggaggaaatctcatcctt

SEQ ID NO: 5174 - DNA, 50 bp, Homo sapiens
ttaacaggacctctgggccaccaaggagaaagggctggggaagccaagag

SEQ ID NO: 5175 - DNA, 50 bp, Homo sapiens
gttctgtgatagtttgtttcccctcatctccctcacctctgcctgggttg

SEQ ID NO: 5176 - DNA, 50 bp, Homo sapiens
ggcccctccttttgctggagagttttttataaactggagcccgatttcat

SEQ ID NO: 5177 - DNA, 50 bp, Homo sapiens
gggctttttcttcccctaatcagggtgacctgggccttttgggcaggatc

SEQ ID NO: 5178 - DNA, 50 bp, Homo sapiens
aaggaggggagtgaatgatattgctgtcatttctcagcaaatcatagtga

SEQ ID NO: 5179 - DNA, 50 bp, Homo sapiens
taaaattctctgtgggaaaaagcctgccaataaaatgggggtttttgggc

SEQ ID NO: 5180 - DNA, 50 bp, Homo sapiens
acagactaagctggtttggtggattcatctttcacttatgaagaaagcag

SEQ ID NO: 5181 - DNA, 50 bp, Homo sapiens
cccaaagcctggggggtttggcccaaaccttccccctggtttttataaaa

SEQ ID NO: 5182 - DNA, 50 bp, Homo sapiens
actgctttcaagaaagtgggaccagtggcattgtagccaccataatcact

SEQ ID NO: 5183 - DNA, 50 bp, Homo sapiens
gcccttggcaaatgatttgagaccccttttgaaaaccatgtaggatgaat

SEQ ID NO: 5184 - DNA, 50 bp, Homo sapiens
cacacagcagtggcttggggatgaggaaggaagggagaatctcaacggag

SEQ ID NO: 5185 - DNA, 50 bp, Homo sapiens
tttttctgtgagttaggggcatggaggcggcagtgttgggagctggagcc

SEQ ID NO: 5186 - DNA, 51 bp, Homo sapiens
agttggctctagtttaaagatataaatacgtacctcacttaaaccccatgt

SEQ ID NO: 5187 - DNA, 50 bp, Homo sapiens
cttcaggcccaagttcaacgggttaaagaggtccgctcccaaattattct

SEQ ID NO: 5188 - DNA, 50 bp, Homo sapiens
gtcccagtagccccatttcagggcttgctagttacatgggtttgtgttta

SEQ ID NO: 5189 - DNA, 50 bp, Homo sapiens
ggatgtgtgatgtttatatgggagaacaaaaagctgatgtatagccctgt

SEQ ID NO: 5190 - DNA, 50 bp, Homo sapiens
caatttccacctctaagggggtcgggaaaggcacgctgagggtgaatatg

SEQ ID NO: 5191 - DNA, 50 bp, Homo sapiens
gctttcaaatgaatttcagggctttctttgaagcagtcttgtaaagttgt

SEQ ID NO: 5192 - DNA, 50 bp, Homo sapiens
tcctttctggataccaggaatcacttaaaaatctgtgtataatgccccca

SEQ ID NO: 5193 - DNA, 50 bp, Homo sapiens
aaacagggaacgacaggaaaaagatgaccgtgatacactctgctaaaagc

SEQ ID NO: 5194 - DNA, 50 bp, Homo sapiens
cccccccggcttcccccttttttccccgcccgtttttttgggggaatggg

SEQ ID NO: 5195 - DNA, 50 bp, Homo sapiens
ggccatgccgggccagccccacctgaagctcagtgaaagctgattaaaaa

SEQ ID NO: 5196 - DNA, 50 bp, Homo sapiens
cgcaggactctaaagatccaagctcacaaaacactccaaatccacctcga

SEQ ID NO: 5197 - DNA, 50 bp, Homo sapiens
aactttacttctgttcttggcaggacatggagagagggagggattccaaa

SEQ ID NO: 5198 - DNA, 50 bp, Homo sapiens
gggtgataattgagggtgccgctgggaaggtccgagaatgggttttcatg

SEQ ID NO: 5199 - DNA, 50 bp, Homo sapiens
gttcattgctgttcagagtgttgctgctgtggtgctataaatgctcccag

SEQ ID NO: 5200 - DNA, 50 bp, Homo sapiens
tattccaccagtgagctacactcccggcccctttagtgttgtttgtaaac

SEQ ID NO: 5201 - DNA, 50 bp, Homo sapiens
ccgtgttgtggcaaaatggtccctggagtttttgaccctgtgtttaaaga

SEQ ID NO: 5202 - DNA, 50 bp, Homo sapiens
ttttttggggccgaaaacccccaatgagggggattaaagctgttttcccc

SEQ ID NO: 5203 - DNA, 50 bp, Homo sapiens
ggggttgtccttttcccaccctgatggggaatttatggatgggtttcctt

SEQ ID NO: 5204 - DNA, 50 bp, Homo sapiens
aaatgagtgaccaaaacacttctgtaccacttctgtgagctgaggtccag

SEQ ID NO: 5205 - DNA, 50 bp, Homo sapiens
aggaacctaaagaaactgccaagtgtagataagcattgagtatgttaccc

SEQ ID NO: 5206 - DNA, 50 bp, Homo sapiens
ggttgtccagttttcggtttttaacgccccccataggggatttggccccc

SEQ ID NO: 5207 - DNA, 50 bp, Homo sapiens
gttttggaatgaggaatgatttttctaagcctgacatcagatgtctgaca

SEQ ID NO: 5208 - DNA, 50 bp, Homo sapiens
gaaattctccccttttcccctctccttcccttctgctgacctgttctcag

SEQ ID NO: 5209 - DNA, 50 bp, Homo sapiens
cacagagggagtgtgcagggccagatttcatcctggggccacgctgaaat

SEQ ID NO: 5210 - DNA, 50 bp, Homo sapiens
tgataggacatagtagtacgggtggtcagacatgaaaatggtggggagcc

SEQ ID NO: 5211 - DNA, 50 bp, Homo sapiens
caatacctacccccagtggcagccgcctgctcctcatgacccaagtaagt

SEQ ID NO: 5212 - DNA, 50 bp, Homo sapiens
tgttttaacaactcttctcaacattttgtccaggttattccctgtaacca

SEQ ID NO: 5213 - DNA, 50 bp, Homo sapiens
taagtgtcaggtttgtggggaaggttattcttgccttgtgtattttgtcc

SEQ ID NO: 5214 - DNA, 50 bp, Homo sapiens
caaacccctatcccccattctcctcctatccctcaaccccgacatcatta

SEQ ID NO: 5215 - DNA, 50 bp, Homo sapiens
cctgcaacagctaaggccaagccaaacttaccgtggactcaaacactttg

SEQ ID NO: 5216 - DNA, 50 bp, Homo sapiens; identical to SEQ ID NO: 372

SEQ ID NO: 5217 - DNA, 50 bp, Homo sapiens
tcccaccccttttctactgaatttgtggggatcctataataaaagtgaat

SEQ ID NO: 5218 - DNA, 50 bp, Homo sapiens
actaccagagccctaggacttctgagcacatttagaaaataccagaggca

SEQ ID NO: 5219 - DNA, 50 bp, Homo sapiens
catgtcagagttcttaacagaaagcaaaggtttccaacagcacttgcatt

SEQ ID NO: 5220 - DNA, 50 bp, Homo sapiens
atgaaatctcatggggccaaactgcacatcagctactgctaccttcttgc

SEQ ID NO: 5221 - DNA, 50 bp, Homo sapiens
ccctgtggcaacttgtgggtacggtttaactggaccacgctgagcttctg

SEQ ID NO: 5222 - DNA, 50 bp, Homo sapiens
agaaatagtgtttctcggaagctcagtttggagctgactgcacacgttgc

SEQ ID NO: 5223 - DNA, 50 bp, Homo sapiens
gttgctggctgccctcccctgcactctccctgaaataaagaacagcttgg

SEQ ID NO: 5224 - DNA, 50 bp, Homo sapiens; identical to SEQ ID NO: 5223

SEQ ID NO: 5225 - DNA, 50 bp, Homo sapiens
acgtgtcagacacaatcctgagccttctacaagtgttccctcttactcct

SEQ ID NO: 5226 - DNA, 50 bp, Homo sapiens
aagccctgtttacccaggtttttcttaaggcgagaaggtttagggtggtg

SEQ ID NO: 5227 - DNA, 50 bp, Homo sapiens
gagaaagctcccagtctgtctttcccaacatcccttcagtttcaataagc

SEQ ID NO: 5228 - DNA, 50 bp, Homo sapiens
ttcaggtgagtgtgcctggaggtggagaactatggttttgataacttggc

SEQ ID NO: 5229 - DNA, 50 bp, Homo sapiens
aaggtgccatgtattgaaagtgtgcgtcaaagaacataaatatcagtgga

SEQ ID NO: 5230 - DNA, 52 bp, Homo sapiens
tgtaattattttctgtatgttcaagaaggtaaaggaaaggacagctatggga

SEQ ID NO: 5231 - DNA, 51 bp, Homo sapiens
atttatttggggttggtcccccctttgggccccccgggttttccctttttt

SEQ ID NO: 5232 - DNA, 50 bp, Homo sapiens
aaccataaaaggcccgtttggttagttttccctgtttcctggtttgggct

SEQ ID NO: 5233 - DNA, 50 bp, Homo sapiens
ttatggggtaactcactttgggcggcacgaagaactccaggcggaagcgt

SEQ ID NO: 5234 - DNA, 50 bp, Homo sapiens
tctctccccatcccaagtcatccagccctttttcctaccctcaataaacc

SEQ ID NO: 5235 - DNA, 50 bp, Homo sapiens
ccccctgatggacttcaaatatgtctcatcaactacagtattaaatgcca

SEQ ID NO: 5236 - DNA, 50 bp, Homo sapiens
cgagaatgcctagggaaaccagctacgcttacaagccagctacgcagccc

SEQ ID NO: 5237 - DNA, 50 bp, Homo sapiens
ggaaacattggcctgggggtgtcccccaaaagggggccgtttttaaaggg

SEQ ID NO: 5238 - DNA, 50 bp, Homo sapiens
tgggttgacattgttcgcacggggtgtttcttatattaaaaagactcact

SEQ ID NO: 5239 - DNA, 50 bp, Homo sapiens
ctttccacaaaataatcgataaccttgggggattgttttatggcttgaca

SEQ ID NO: 5240 - DNA, 50 bp, Homo sapiens
ccgccttggggagacaggtcttgattgtctttttcccagtgaacattgtt

SEQ ID NO: 5241 - DNA, 50 bp, Homo sapiens
tcccagactttcaggaaagtaactgtagcactgttaatatcacaacaaca

SEQ ID NO: 5242 - DNA, 50 bp, Homo sapiens
ttttagctgggagtggggggactatggggaataactttccttcatttaat

SEQ ID NO: 5243 - DNA, 50 bp, Homo sapiens
acatgtgtgtgttttccatgaggcactgctttttatgcatttccctcccc

SEQ ID NO: 5244 - DNA, 50 bp, Homo sapiens
ctgtatttgaagtcagcagggctcagcaggatttgaccgacagttacctc

SEQ ID NO: 5245 - DNA, 50 bp, Homo sapiens
tggtttatagatgcacttcctttcataggcagtccctggcactttcttgc

SEQ ID NO: 5246 - DNA, 50 bp, Homo sapiens
aggagctggtattattggagggtattatagatccagtgtattgtgactgt

SEQ ID NO: 5247 - DNA, 50 bp, Homo sapiens
gcagtagtgctaaggcgtcttttgtaggctttagattttgtcgttatggc

SEQ ID NO: 5248 - DNA, 50 bp, Homo sapiens
gcttgtcagaacagaagatatttccaccctgcctagtagatgtgtttcag

SEQ ID NO: 5249 - DNA, 50 bp, Homo sapiens
cccccgttttaggttagggccttgggcaggggtttgccccctgttacccc

SEQ ID NO: 5250 - DNA, 50 bp, Homo sapiens
ttggttttatttatccaaaactgagccttctcataggctttacacccgga

SEQ ID NO: 5251 - DNA, 50 bp, Homo sapiens
ggcaggctctagccaccctgtcggttcccaataagccatttattgaataa

SEQ ID NO: 5252 - DNA, 50 bp, Homo sapiens
tttttgaccagtctacatttcgtatctgtgggatctgcatttgtgaattc

SEQ ID NO: 5253 - DNA, 50 bp, Homo sapiens
tctggacaatgttgatgctaaccttgatgatatccatccctattactggg

SEQ ID NO: 5254 - DNA, 50 bp, Homo sapiens
aggacatgaaggtctgaaaaagaaacaggaaaatacagacatccccgctt

SEQ ID NO: 5255 - DNA, 50 bp, Homo sapiens
aagtcaaggaaccctctcgggtctctgagatccaggccaacagtaaacag

SEQ ID NO: 5256 - DNA, 51 bp, Homo sapiens
agggggctttaaaatttaaaaattgccttttgttttaaaaaaggcccatgt

SEQ ID NO: 5257 - DNA, 50 bp, Homo sapiens
ccccctcccacccaaagaaaaagaaatggtaactacctggacaaaacatt

SEQ ID NO: 5258 - DNA, 50 bp, Homo sapiens
cccttggctcttattgttcttgctggtgtggtatgttcccggctgaaaaa

SEQ ID NO: 5259 - DNA, 50 bp, Homo sapiens
ttccccttttttcccccttttttaaaaagccccttttttaaatggggcgc

SEQ ID NO: 5260 - DNA, 50 bp, Homo sapiens
aaggacagcttgcttgctgatgaacacttccacagtcttttgagctaagt

SEQ ID NO: 5261 - DNA, 51 bp, Homo sapiens
acatgagaattaaccatgtccagtagttaagttcattttcctacagtgtgc

SEQ ID NO: 5262 - DNA, 50 bp, Homo sapiens
gccagaatggtacagagtggagggtgttctgctaatgacttcagagaagt

SEQ ID NO: 5263 - DNA, 50 bp, Homo sapiens
gcacaacttctgggaatctagtggctgtatgttaaagcatcggtaaaaga

SEQ ID NO: 5264 - DNA, 50 bp, Homo sapiens
aaaaaggccccttgtttgttggtttttggcccgttggggaaaatgcctgt

SEQ ID NO: 5265 - DNA, 50 bp, Homo sapiens
tttaggagctgaccatacatgatgagtgatacagcctgtactttgctcat

SEQ ID NO: 5266 - DNA, 50 bp, Homo sapiens
ggtttcccacgaacgggaggctgctgaagagtcaaagcctgggcagactc

SEQ ID NO: 5267 - DNA, 50 bp, Homo sapiens
caggtcatgagtattccaagctcaggtggtgagtcctcctcaccgggatg

SEQ ID NO: 5268 - DNA, 50 bp, Homo sapiens
aaagggaaactggctctggcaccacctactggagaccaaacttcaccaaa

SEQ ID NO: 5269 - DNA, 50 bp, Homo sapiens
gacaaaatagttacctatgctttccttctggcaccccgaatgtacgcagg

SEQ ID NO: 5270 - DNA, 50 bp, Homo sapiens
atctgacctgagggagatcacaaatgccttctgtattgggtggtaatgat

SEQ ID NO: 5271 - DNA, 50 bp, Homo sapiens
tccgttgtaacacatctaatgtgaacgcattataaacatggacctgtact

SEQ ID NO: 5272 - DNA, 51 bp, Homo sapiens
acataactattccgttgatgaatagcatcaggacttaaatggtgaccttgt

SEQ ID NO: 5273 - DNA, 51 bp, Homo sapiens
aacgggtttgggtttgggggggtttgttctttttattgaatccatttaagt

SEQ ID NO: 5274 - DNA, 50 bp, Homo sapiens
tataggagatgggatactcattcccgctgctattgataaggtcggaggcg

SEQ ID NO: 5275 - DNA, 50 bp, Homo sapiens
cagaacgtcctcaaggacacactcctccctcgggcctcactctggagcac

SEQ ID NO: 5276 - DNA, 50 bp, Homo sapiens
ctggacatgttgtttccatgttcagtcccttcccggtttttgggtgtttt

SEQ ID NO: 5277 - DNA, 50 bp, Homo sapiens
aaagtagccatcctgagtctccagggtgatgagcggacttgggtgtggat

SEQ ID NO: 5278 - DNA, 50 bp, Homo sapiens
ccttccatctcatcggtggcctctcactgtggctcactgtttaacacatg

SEQ ID NO: 5279 - DNA, 50 bp, Homo sapiens
tgttcaaggtcacatagtttaggtaagaagctcaaacctgagttttaggt

SEQ ID NO: 5280 - DNA, 50 bp, Homo sapiens
cacctgattccccctcttgcccacaggactctgctgttgttttcattctg

SEQ ID NO: 5281 - DNA, 50 bp, Homo sapiens
tctcgtgaggtgatgtggtgctgcagacttaagctatctgccttgaagat

SEQ ID NO: 5282 - DNA, 50 bp, Homo sapiens
aacaagcctggaataatgcccccaaagattgagtggaaatcgcccctttt

SEQ ID NO: 5283 - DNA, 50 bp, Homo sapiens
caggaccagatggcccaggaggaagtggatgctttcttggtagggaatgg

SEQ ID NO: 5284 - DNA, 50 bp, Homo sapiens
cctcctgctagaagacagatttcttccttggctgacaggctgaattaagc

SEQ ID NO: 5285 - DNA, 50 bp, Homo sapiens
aatttccaaaaacaaaacaaaacaagcaggtttcatggagcccgagtcca

SEQ ID NO: 5286 - DNA, 50 bp, Homo sapiens
cctttatgcaagttgtaaggggttgaccagtaaagaggaagttttgcccc

SEQ ID NO: 5287 - DNA, 50 bp, Homo sapiens
agtattagctacaaacaagccttgtttcctcttggctgtcaggcactgct

SEQ ID NO: 5288 - DNA, 50 bp, Homo sapiens
aagccccagtaaggtgttcaggactggtaaacgactgtcctcaagtaagg

SEQ ID NO: 5289 - DNA, 50 bp, Homo sapiens
tggttcaggtagtaaatgcttttggtcacatcagaactctagatctgggg

SEQ ID NO: 5290 - DNA, 50 bp, Homo sapiens
gcctgggctgtttttgctatatgtaaataaagcccttgggtctttatttt

SEQ ID NO: 5291 - DNA, 50 bp, Homo sapiens
ggaggttaggaagcccttttaaagtacaaacccccggcatggggaatttt

SEQ ID NO: 5292 - DNA, 50 bp, Homo sapiens
aacgggagtgatcgggaagtgaacagtttcatcatctgctgctgctattc

SEQ ID NO: 5293 - DNA, 50 bp, Homo sapiens
ctggtatgttgctttgtaggggaaaaactaattttgttgggtcagggaca

SEQ ID NO: 5294 - DNA, 50 bp, Homo sapiens
ccggacaagccatttgatgttctagtttgcaattactccacgcaaagtgg

SEQ ID NO: 5295 - DNA, 50 bp, Homo sapiens
tttgggcatcaacttcaacaactactaccaggacgcctgagggtgctttt

SEQ ID NO: 5296 - DNA, 50 bp, Homo sapiens
tcgaagaaagtacctgtaaatgtagagtaattgcgaagctgtcaggaata

SEQ ID NO: 5297 - DNA, 50 bp, Homo sapiens
tcctagaccctgcattgtgaaatggggcttgaattttagttctgaatttt

SEQ ID NO: 5298 - DNA, 50 bp, Homo sapiens
ctaaagcagtgtctgacctggatttgctgccaatttgtaagctttcatga

SEQ ID NO: 5299 - DNA, 50 bp, Homo sapiens
ggagctgagcagggatgcaaaaccatccagtctgtaagattcacagagac

SEQ ID NO: 5300 - DNA, 50 bp, Homo sapiens
aaacggtgtttgagctgctttgggaaaacccatgttgcagattttcaggt

SEQ ID NO: 5301 - DNA, 50 bp, Homo sapiens
cagagctgtgtttcctcaacaagtgtgcgagcggtcgtgtgcgccatgag

SEQ ID NO: 5302 - DNA, 50 bp, Homo sapiens
aaatcgcttctgtattgttaatagcaatatatgacctctgctgtcctcct

SEQ ID NO: 5303 - DNA, 50 bp, Homo sapiens
gaaaggataatttcgaacccttgcatagtttcggtatgggccgtgccaac

SEQ ID NO: 5304 - DNA, 50 bp, Homo sapiens
ccctcttgaactgcactgcctaagaaatgttggttgcatggagacatatt

SEQ ID NO: 5305 - DNA, 50 bp, Homo sapiens
tctgccttatttggcttggaagagaaaccgataaacactcccgtgctagt

SEQ ID NO: 5306 - DNA, 50 bp, Homo sapiens
aaacagcagaaaagtaatttctggtgaactgatgagaattccctattgca

SEQ ID NO: 5307 - DNA, 50 bp, Homo sapiens
aggttgttttggaaaaattatttgttttgtcctaaggggtcctgcccacc

SEQ ID NO: 5308 - DNA, 52 bp, Homo sapiens
cctccggaacgtttttaaaaaggaaaaagcccgggttttcccttgggaaaaa

SEQ ID NO: 5309 - DNA, 50 bp, Homo sapiens
cagacctgtgggctgattccagactgagagttgaagttttgtgtgcatca

SEQ ID NO: 5310 - DNA, 50 bp, Homo sapiens
accaagtttgaatttgtcaaatcccaagtcaatccaggatgttcatttct

SEQ ID NO: 5311 - DNA, 50 bp, Homo sapiens
agtgatctgcctttcagcaactgtcttattttggttctttgaaactgtga

SEQ ID NO: 5312 - DNA, 50 bp, Homo sapiens
tttgaatggctgaagctaaggcaacgttagtttctccttactctgctttt

SEQ ID NO: 5313 - DNA, 50 bp, Homo sapiens
acctttgtgattctgtctagtgaaaatgggacatttttaatagtgccaga

SEQ ID NO: 5314 - DNA, 50 bp, Homo sapiens
gaacttgcccctaaactgggttaaatggaccctgttgagttttctggaca

SEQ ID NO: 5315 - DNA, 50 bp, Homo sapiens
taaattgggcaaagttttttatggaatttccggggcaaggttttgggggc

SEQ ID NO: 5316 - DNA, 50 bp, Homo sapiens
aaatctcatttgcaagttctcccattaagcaagggagtagtttactagga

SEQ ID NO: 5317 - DNA, 50 bp, Homo sapiens
aagaaaggcccataacagatggcaaaatagaggattggtgagggatatgc

SEQ ID NO: 5318 - DNA, 50 bp, Homo sapiens
aaaaccattccagcttaatgcctttaattttaatgccaacaaaattgggg

SEQ ID NO: 5319 - DNA, 50 bp, Homo sapiens
tgcaaccttcttaaaatgtgggctactggagatcatgccactgcactcca

SEQ ID NO: 5320 - DNA, 50 bp, Homo sapiens
agctcagatgggtccccaaaagaggcataggaaagcgcgacctcactgcc

SEQ ID NO: 5321 - DNA, 50 bp, Homo sapiens
caaataaaaaggctggggccaaaggtgggcaccaaaagtcctcctatgtg

SEQ ID NO: 5322 - DNA, 50 bp, Homo sapiens
tgcagctcccatttcctgagcgtctaccaggtactaggagaactcttaca

SEQ ID NO: 5323 - DNA, 50 bp, Homo sapiens
attatccttttccccaggaagccctcggcccccaaaaagggaaacagttt

SEQ ID NO: 5324 - DNA, 50 bp, Homo sapiens
catgagcccaggggtttcatgacaaacattactagcatgttcaactgccc

SEQ ID NO: 5325 - DNA, 50 bp, Homo sapiens
gcccggtttatggaaaaaccaggaccagtttatgtttggggttttgggaa

SEQ ID NO: 5326 - DNA, 50 bp, Homo sapiens
gcttggtactgtcatagtgattacaaatttcatggaatgcgaagagcaac

SEQ ID NO: 5327 - DNA, 50 bp, Homo sapiens
ttttctcccctctcttccccttccacgaactgcaataccagtaaccttgg

SEQ ID NO: 5328 - DNA, 50 bp, Homo sapiens
aagcccagatacacaaaattccaccccatgatcaagaatcctgctccact

SEQ ID NO: 5329 - DNA, 50 bp, Homo sapiens
catgtgttgactctgtaatggatttatgtagcccacttcagtctgcaaat

SEQ ID NO: 5330 - DNA, 50 bp, Homo sapiens
aggggtgtcccttttccccttcatgtaaaattctaactggggctaccagt

SEQ ID NO: 5331 - DNA, 50 bp, Homo sapiens; identical to SEQ ID NO: 4387

SEQ ID NO: 5332 - DNA, 50 bp, Homo sapiens
tgaagaaactgccctttctgtgatgtttttgaatactacccaacagccaa

SEQ ID NO: 5333 - DNA, 50 bp, Homo sapiens
cttcctagccctaagtttggcctttgggtggctccaaaaaggattaggtt

SEQ ID NO: 5334 - DNA, 50 bp, Homo sapiens
tccccctcgttttgtagggtttgtacataataaaacaatggggtggggcc

SEQ ID NO: 5335 - DNA, 50 bp, Homo sapiens
tgttaagtgtgaggttttctgaacccttagcagaaggacttttaatgttt

SEQ ID NO: 5336 - DNA, 50 bp, Homo sapiens
agttccactgctgttcctcttaccttgattaaatgcctatgcatgtactt

SEQ ID NO: 5337 - DNA, 50 bp, Homo sapiens
agttctgttgtgtaatctggtgctggttccctgggcatatgtattctgtg

SEQ ID NO: 5338 - DNA, 50 bp, Homo sapiens
cccccttgcttggttttaagtaggtatggaatgttattataggccatagt

SEQ ID NO: 5339 - DNA, 50 bp, Homo sapiens
tcagtgtaaacataattaggccgtgagtttttgctcttactcccaggttt

SEQ ID NO: 5340 - DNA, 50 bp, Homo sapiens
tgtaaacttgttttaacaactcttttcaacattttggccggggtattccc

SEQ ID NO: 5341 - DNA, 50 bp, Homo sapiens
tgctgaaagtggtcccaaaggggtactagtttttaagctcccaactcccc

SEQ ID NO: 5342 - DNA, 50 bp, Homo sapiens
ttcccagttgccacagaccgtttatatgaagaaatgctaaagaagttccc

SEQ ID NO: 5343 - DNA, 50 bp, Homo sapiens; identical to SEQ ID NO: 4387

SEQ ID NO: 5344 - DNA, 51 bp, Homo sapiens
agttctaaagccgggaattcctaaggatatactaaatgagattatgtgtgg

SEQ ID NO: 5345 - DNA, 50 bp, Homo sapiens
gcctgggggaggagaagtcccttcccattccagctcgatcaatcttgctg

SEQ ID NO: 5346 - DNA, 50 bp, Homo sapiens
ggagtagagagagtcttgctacatgcgggaactagaattacatcactgcg

SEQ ID NO: 5347 - DNA, 50 bp, Homo sapiens
aagaagtttcattgatatccactggtcacatcatacctgtctatagggca

SEQ ID NO: 5348 - DNA, 50 bp, Homo sapiens
tgcttcaagcacaggatttatggaatagttggcaaattaaacaacatgct

SEQ ID NO: 5349 - DNA, 50 bp, Homo sapiens
cggcagccttatggaatgagtttcttgtcatgaatgttgtccccaaagct

SEQ ID NO: 5350 - DNA, 50 bp, Homo sapiens
acagttactttggagctgctagactggttttctgtgttggtaaattgcct

SEQ ID NO: 5351 - DNA, 50 bp, Homo sapiens
tgtgaagaatccctaccattaataccctgggtgggataaataaaaatggg

SEQ ID NO: 5352 - DNA, 50 bp, Homo sapiens
cccaaaatttgtttaaagttccgacttccaaaaggggccaataaaaaggg

SEQ ID NO: 5353 - DNA, 51 bp, Homo sapiens
caccgcctctgcctccgcctcttccactggagagcccgaggtcaaaaggtc

SEQ ID NO: 5354 - DNA, 50 bp, Homo sapiens
ccctcacctagcagtactaccacaataatgctatcatggtgccagggaat

SEQ ID NO: 5355 - DNA, 50 bp, Homo sapiens
tctccttccccattgggccgcctttatcaattgcctgttttgttttgttt

SEQ ID NO: 5356 - DNA, 50 bp, Homo sapiens
tttttatctttcttggtgggggtgtggtggtggtgaagaggacctaaaaa

SEQ ID NO: 5357 - DNA, 50 bp, Homo sapiens
cgccagaggtcagaacatgtctattttgaattggatcgttacaaatgagc

SEQ ID NO: 5358 - DNA, 50 bp, Homo sapiens
gcaggcactgacatttttgagcaaagacgtgatgttatgagataaatatc

SEQ ID NO: 5359 - DNA, 50 bp, Homo sapiens
ttctgacacgattacacaacgaggctttaatgccatttgggtaggtgagc

SEQ ID NO: 5360 - DNA, 51 bp, Homo sapiens
ttttaaaggggaggggccggggtttggtccccggtcccaaaggtaaaagtt

SEQ ID NO: 5361 - DNA, 50 bp, Homo sapiens
gagtgagaagaggcttttaaggaccatgtgaagaggcttttaaacacttt

SEQ ID NO: 5362 - DNA, 50 bp, Homo sapiens
gggttgggataaactgcttagatgtttgcctacttgtccagtgaaattac

SEQ ID NO: 5363 - DNA, 50 bp, Homo sapiens
actgaaaagttgaaagacttttgcagtgaacatttatataactccccgct

SEQ ID NO: 5364 - DNA, 50 bp, Homo sapiens
attcataggtagtgcccagagagagtacaagctctgactcatatggcagt

SEQ ID NO: 5365 - DNA, 50 bp, Homo sapiens
acatgttacctggagtagctgtgtcaacagattaatatggaatgctacta

SEQ ID NO: 5366 - DNA, 50 bp, Homo sapiens
tggttcctgtgctcaccatagggctggtgtacattgggccattaataaac

SEQ ID NO: 5367 - DNA, 50 bp, Homo sapiens
acagatccctattgccagacacatcattctctccatccagaaagcaaaca

SEQ ID NO: 5368 - DNA, 50 bp, Homo sapiens
tctgggaaagacatttttaagctgctgacttcacctgcaaaatctaacag

SEQ ID NO: 5369 - DNA, 50 bp, Homo sapiens
agtcacgataaacctggtcacctgaaaattgaaattgagccacttccttg

SEQ ID NO: 5370 - DNA, 50 bp, Homo sapiens
aaactggcggcccaacaaaacagtgggttaaatgggtccctgggtgacat

SEQ ID NO: 5371 - DNA, 50 bp, Homo sapiens
agtgtttcctccacatctaaagaaagcccattttgaaactggatactgca

SEQ ID NO: 5372 - DNA, 50 bp, Homo sapiens
cccaggtggcccctctccatcagatgttattgctcttccccatttattta

SEQ ID NO: 5373 - DNA, 50 bp, Homo sapiens
aagatgcctaagcgttaaccaggtgaaacaggggtgggagagagaaagaa

SEQ ID NO: 5374 - DNA, 50 bp, Homo sapiens
gtcatacacctatcccccattttcctcctatccctcaacccggacatcat

SEQ ID NO: 5375 - DNA, 50 bp, Homo sapiens
gcaggtggcagaatggggtgcatgaaggtttctgaaaattaacactgctt

SEQ ID NO: 5376 - DNA, 50 bp, Homo sapiens
acagagaggcagcatttgttttccagttaaaatttgacctcactgtgatt

SEQ ID NO: 5377 - DNA, 50 bp, Homo sapiens
cccccttttgttgtggttttatattggaaccccctttttctttggaacta

SEQ ID NO: 5378 - DNA, 50 bp, Homo sapiens
ctgaccccttcctcacccctgccaacagtggtggcatatatcacaaatgg

SEQ ID NO: 5379 - DNA, 50 bp, Homo sapiens
tgttttacctcactgttggacatacattccaagcttttcaactctaggag

SEQ ID NO: 5380 - DNA, 50 bp, Homo sapiens
cagaacatgcccaaagaagcctatatcttgctgctgggaaatgtaaagca

SEQ ID NO: 5381 - DNA, 50 bp, Homo sapiens
caaacaccggcagttgaaaggaaaaggacggggaatgtgatggaaaagag

SEQ ID NO: 5382 - DNA, 50 bp, Homo sapiens
ccccctccctgccccggtgagctttggggaacccaaaaattagattttgc

SEQ ID NO: 5383 - DNA, 50 bp, Homo sapiens
cccaaatccaaggaccaatgctgttgtaaacaaggggtaaagggcctaaa

SEQ ID NO: 5384 - DNA, 50 bp, Homo sapiens
actccaccaagactgtgaactccaccggggtaggaagcatattttactca

SEQ ID NO: 5385 - DNA, 50 bp, Homo sapiens
gagaactcgtttcaaggaactcgatgtttccggggaccaagcccgcccag

SEQ ID NO: 5386 - DNA, 50 bp, Homo sapiens
ccagcgaatttccagcttttgaaactcagatttccttttgcgacccaggt

SEQ ID NO: 5387 - DNA, 50 bp, Homo sapiens
gatgcgcggcaagaatgtacctgtagatgtgtacataccacagtgctgta

SEQ ID NO: 5388 - DNA, 50 bp, Homo sapiens
tttatctcagaatcttgatgaactctgaaatgacccctgatgggggcatg

SEQ ID NO: 5389 - DNA, 50 bp, Homo sapiens
ggccccctgtccttacctgttttcggcccccttaattttttaaccccggg

SEQ ID NO: 5390 - DNA, 50 bp, Homo sapiens
gtcacagtgtagacacatggtgcttccatagtgagtagaatatccattgt

SEQ ID NO: 5391 - DNA, 50 bp, Homo sapiens
gtggcctggcctggctctcacagacccaaggcttccgtgtagaatatgtc

SEQ ID NO: 5392 - DNA, 50 bp, Homo sapiens
ggattgtggcaggaactgtttcccctcccagccttaaatttttctgtgtt

SEQ ID NO: 5393 - DNA, 50 bp, Homo sapiens
aaacccacacctcagtgaatttaaaagagtagatgttttaaaagaccgga

SEQ ID NO: 5394 - DNA, 51 bp, Homo sapiens
tgccatttggtattttttcctgaaacattacataataagaatgcagcatgc

SEQ ID NO: 5395 - DNA, 50 bp, Homo sapiens
gcctgaaaccatcctgccttctaggaagacagcaattctggaagagcaag

SEQ ID NO: 5396 - DNA, 50 bp, Homo sapiens
ggtggttccccagcccttttccctggccctgggttggaaaatttgttttc

SEQ ID NO: 5397 - DNA, 51 bp, Homo sapiens
aaaacctttcgcccggcttaaaatttaccggggtttggttttatttggttt

SEQ ID NO: 5398 - DNA, 50 bp, Homo sapiens
ctccttggtgtcatgcaactgaggaacctaattggctgggtgggttgttc

SEQ ID NO: 5399 - DNA, 50 bp, Homo sapiens
gtttgtaaaagaacctgccacatttgttgaaaagttagagccatcacagc

SEQ ID NO: 5400 - DNA, 50 bp, Homo sapiens
ctcttggctgctggccttttgttcttgtcatggctcattagctccctaaa

SEQ ID NO: 5401 - DNA, 50 bp, Homo sapiens
ccaggggtttttaaattttctgaagtttttggggccattttggttgttgg

SEQ ID NO: 5402 - DNA, 50 bp, Homo sapiens
ccccgcttgccttttatttcagaaccccaagtattacccaatatgttaca

SEQ ID NO: 5403 - DNA, 50 bp, Homo sapiens
gccgaagctcacagaggctaagttacacgcttaggtgttcttattcctac

SEQ ID NO: 5404 - DNA, 50 bp, Homo sapiens
aaccaggtttatgatgctgtaataaaccatggcattaaagagggcaagag

SEQ ID NO: 5405 - DNA, 50 bp, Homo sapiens
gggttaaggagggccgctccaaaattttcctttttcccaggaagcccttg

SEQ ID NO: 5406 - DNA, 50 bp, Homo sapiens
atgctgtgagtggtacacatggctgaggttatgatctgttaaaatatgta

SEQ ID NO: 5407 - DNA, 50 bp, Homo sapiens
ttcattaattcctcaacccaatactgtctggcttccaccaacaggagcgg

SEQ ID NO: 5408 - DNA, 50 bp, Homo sapiens
tggtttctattttaaaaacctgggttaggccaaggtttggggttcgccct

SEQ ID NO: 5409 - DNA, 50 bp, Homo sapiens
caacattgcctaccagttgcagttcattagccccgtccgccccagcattg

SEQ ID NO: 5410 - DNA, 50 bp, Homo sapiens
cctttggggtgggggctttttcctttttggccggttcaattaaggttttt

SEQ ID NO: 5411 - DNA, 50 bp, Homo sapiens
cccactccggctgttttagaagttttcccgaatccgtgatccctttacaa

SEQ ID NO: 5412 - DNA, 50 bp, Homo sapiens
aatgggcaaattttacccaaaacttaagcttgcctattccgtttgaggca

SEQ ID NO: 5413 - DNA, 50 bp, Homo sapiens
gaaggagaggcacacacaaatacacacactcacacaaaactcaacaacca

SEQ ID NO: 5414 - DNA, 50 bp, Homo sapiens
ggataccccctttatcccgagggaatttttaccctttggatgcctttaaa

SEQ ID NO: 5415 - DNA, 50 bp, Homo sapiens
caaattacaaacctaaaaatacagaacatcagcggagaagacaggagagc

SEQ ID NO: 5416 - DNA, 50 bp, Homo sapiens
ctcctcccttgggtgggacctgggttgggggtttgatagaaaaattaacc

SEQ ID NO: 5417 - DNA, 50 bp, Homo sapiens
ggttaaactagatccctgcaaggccatcacctccattccaagttgttact

SEQ ID NO: 5418 - DNA, 50 bp, Homo sapiens
agtgggttattttagatcttttcctggggttcaggtcacatagcttaact

SEQ ID NO: 5419 - DNA, 50 bp, Homo sapiens
tgtttgggtatattgtttgggttttgggcactaggatgggtgactcaggg

SEQ ID NO: 5420 - DNA, 50 bp, Homo sapiens
gccagtgaatctagttttggctattctgtattttgtccagtttttcccat

SEQ ID NO: 5421 - DNA, 50 bp, Homo sapiens
aaccattttcccccgggaacccgttttgcctggtttcggattttttaccc

SEQ ID NO: 5422 - DNA, 50 bp, Homo sapiens
ccgggaagcggggtactggctgtgtttaatcattaaaggtaccgtgtccg

SEQ ID NO: 5423 - DNA, 50 bp, Homo sapiens
tttttccccctcccaaattcactgcattacagtttttgaaacagaacggg

SEQ ID NO: 5424 - DNA, 50 bp, Homo sapiens
tacgagaagtcaggaagttttgaaatggcagtgacaggagacgggggaag

SEQ ID NO: 5425 - DNA, 50 bp, Homo sapiens
aagggcaggcaaatcaattaaaattagccgtaacaacaacctcgggggtg

SEQ ID NO: 5426 - DNA, 50 bp, Homo sapiens
agtacacggccctcaaaagttatatgtgctgaatgtaacctacttagcga

SEQ ID NO: 5427 - DNA, 51 bp, Homo sapiens
ttgttttaacaactcttctcaacattttgtccaggttattcactgtaacca

SEQ ID NO: 5428 - DNA, 50 bp, Homo sapiens
cttctccacctcggccaggtatagggccagcttctcgtctctgggatccg

SEQ ID NO: 5429 - DNA, 50 bp, Homo sapiens
gccaggtcattgtatagggagtaagatgaaggtgaatttgcagctagttg

SEQ ID NO: 5430 - DNA, 50 bp, Homo sapiens
tgtgttttgtttttctggtcccagggcaccgtttgttttgtgaactcctc

SEQ ID NO: 5431 - DNA, 50 bp, Homo sapiens
catggctctaaaatttggaattaacttctcttgccttaagagctgcttgt

SEQ ID NO: 5432 - DNA, 50 bp, Homo sapiens
gctggtgggaagttgagccatgtttatctctagtggaatccttaccttgt

SEQ ID NO: 5433 - DNA, 50 bp, Homo sapiens
catgtttacacaaattccttcaaagccccttaaacatggggccgggcccc

SEQ ID NO: 5434 - DNA, 50 bp, Homo sapiens
accctaatagctaggctgggtatattttcaaagtgtagcgaaaccccacg

SEQ ID NO: 5435 - DNA, 50 bp, Homo sapiens
cagttggcctcctacaattgggaattctaccaagctccaagttgacctgg

SEQ ID NO: 5436 - DNA, 50 bp, Homo sapiens
ggattcccgacaaaggcttgatgtgtacttgaagtgagcaaagggttttg

SEQ ID NO: 5437 - DNA, 50 bp, Homo sapiens
gggtgggagacaggctaatcctttccccttgttttccacgtctttatgac

SEQ ID NO: 5438 - DNA, 51 bp, Homo sapiens
acaaccttcttaatatattagagacccgcaggaaacatttagtggtgaaac

SEQ ID NO: 5439 - DNA, 51 bp, Homo sapiens
gtacatgtttgtgtgctaaattgctcatttggcagtgatagattgaaaaac

SEQ ID NO: 5440 - DNA, 50 bp, Homo sapiens
gggggtcaaagagggtacaaatgtatgggggtatattgaatgctaaacat

SEQ ID NO: 5441 - DNA, 50 bp, Homo sapiens
gggagcccgttttagaaggaagggcaaaagtagggtttttaacccaaacg

SEQ ID NO: 5442 - DNA, 50 bp, Homo sapiens
tccgtcccattcccccggaaaacaaggttttgaattggcccgtaaaaggg

SEQ ID NO: 5443 - DNA, 50 bp, Homo sapiens
acgtccttatacaatgcactgtttgatttttaaacaatacctgaagggct

SEQ ID NO: 5444 - DNA, 50 bp, Homo sapiens
actcaatactcgggaaaggcttcacatttctgggactcagcattatccaa

SEQ ID NO: 5445 - DNA, 50 bp, Homo sapiens
ttgagaggcaacacttaaacactagggctactgtggcatctatgtagaca

SEQ ID NO: 5446 - DNA, 50 bp, Homo sapiens
agccctttcttgttgctgtatgtttagatgctttccaatcttttgttact

SEQ ID NO: 5447 - DNA, 50 bp, Homo sapiens
ggggtatggtttagtaatatccaccagaccttccgatccagcagtttggt

SEQ ID NO: 5448 - DNA, 50 bp, Homo sapiens
aacaacaacagcaaaatccccttagtgcgtaacttgaaattcccttcggc

SEQ ID NO: 5449 - DNA, 50 bp, Homo sapiens
ttgtaagtgggtgcataagaagatctcttcaattaaatgcccccgctggt

SEQ ID NO: 5450 - DNA, 50 bp, Homo sapiens
ataattaagaaatcagccgtgtgcttctcacgtttgggctccgagacgtg

SEQ ID NO: 5451 - DNA, 50 bp, Homo sapiens
gtcagtctcctcacctgcctctgctcctcgcttagcccattgattgcatc

SEQ ID NO: 5452 - DNA, 50 bp, Homo sapiens
gggaagaagcccgtgcccccacccaataaatgttggttttggccctgatg

SEQ ID NO: 5453 - DNA, 50 bp, Homo sapiens
cagaacttctggcgaaggccatgtaagaactactccaaggaggaagaggc

SEQ ID NO: 5454 - DNA, 50 bp, Homo sapiens
ctctaccataaggcactatcagagactgctactggagtgtatatttggtt

SEQ ID NO: 5455 - DNA, 50 bp, Homo sapiens
actgctacagcttaaccattgttccaagctaattaaattacctttgggga

SEQ ID NO: 5456 - DNA, 50 bp, Homo sapiens
caattgtgatttggaaggtttaactgggtctgcccagatgtttacgaata

SEQ ID NO: 5457 - DNA, 50 bp, Homo sapiens
tccaagcaaaagttatgcaataagacagaatataaagtctccgagagcct

SEQ ID NO: 5458 - DNA, 50 bp, Homo sapiens
gggtggggtggggtgagagtgtgtggagtaaggaccttcagaattaatat

SEQ ID NO: 5459 - DNA, 51 bp, Homo sapiens
tgcagttcttattttcttttgcctgtgataattgcaaatccgtcaatagaa

SEQ ID NO: 5460 - DNA, 50 bp, Homo sapiens
tgcaagtttctgagactgtgaaaagtgttttgcttcttttgttacccaat

SEQ ID NO: 5461 - DNA, 50 bp, Homo sapiens
tcccagcgaatgtgaatcatttagtgtgctactcaaaattaggtgtccac

SEQ ID NO: 5462 - DNA, 50 bp, Homo sapiens
taagatgtaggggccaccggccagcagtacccagcaatgaccactatcag

SEQ ID NO: 5463 - DNA, 50 bp, Homo sapiens
ataaatgaaagcataccaagtgctgtccattccataggtacaactatgga

SEQ ID NO: 5464 - DNA, 50 bp, Homo sapiens
ctggtattctgaggtcagatgtaggctgttgctcgctccggctgggtctc

SEQ ID NO: 5465 - DNA, 50 bp, Homo sapiens
ccatcgggggtattggggttttgggctgaatttacttgattattggaaaa

SEQ ID NO: 5466 - DNA, 50 bp, Homo sapiens
gccagattgtggcaggtaaagagacaatgtaatttgcactccctatgata

SEQ ID NO: 5467 - DNA, 50 bp, Homo sapiens
tttaaaaaggagggaggatttctgggttaaaacttttatttggcccccat

SEQ ID NO: 5468 - DNA, 50 bp, Homo sapiens
taaaacccaagacttcagattcagccgaattgtggtgtttcacaaggccg

SEQ ID NO: 5469 - DNA, 50 bp, Homo sapiens
ctaagcatggggaagggggcagagtgaggactgtgccattgattaaagtg

SEQ ID NO: 5470 - DNA, 50 bp, Homo sapiens
gtacagaaacatattccatgctttgaaataaagggaagtgctctcctgtt

SEQ ID NO: 5471 - DNA, 50 bp, Homo sapiens
gaagccttttcttttctgttcaccctcaccaagagcacaacttaaatagg

SEQ ID NO: 5472 - DNA, 51 bp, Homo sapiens
accgatcgtttttaggataatatgcatgtttcaagtggtattgaaaccccc

SEQ ID NO: 5473 - DNA, 50 bp, Homo sapiens
tgagggacaggctgcctaaagtctaattggagagttaacctaatgtctgt

SEQ ID NO: 5474 - DNA, 50 bp, Homo sapiens
caccatcgtggctctgagaactgacgccgtgaatgttgacctgagtgccg

SEQ ID NO: 5475 - DNA, 50 bp, Homo sapiens
ggggagagaccaccctagacatttgcatttttgtaagttagccagccaat

SEQ ID NO: 5476 - DNA, 50 bp, Homo sapiens
tggataaatctgagcaactttcttctttgtgctccaggaacctacgcact

SEQ ID NO: 5477 - DNA, 50 bp, Homo sapiens
tgtgggttttgattgacatactgttgttcatgctgaagtttgagtgtcgt

SEQ ID NO: 5478 - DNA, 50 bp, Homo sapiens
ggtgtgcagtccgcctgaaagccttccctttagctattaggaattgagtc

SEQ ID NO: 5479 - DNA, 53 bp, Homo sapiens
acattggaaagaaaccctacaactgtaatgaatatgaaaagaattgtctaaaa

SEQ ID NO: 5480 - DNA, 50 bp, Homo sapiens
aaaaccgttttccccatacataaagaacaggggtactcccgccctgatgg

SEQ ID NO: 5481 - DNA, 50 bp, Homo sapiens
tttggtgaagtgaaagagagaagttgctctaaaaggttggaaaccagccc

SEQ ID NO: 5482 - DNA, 50 bp, Homo sapiens
tggactgttgtaatgttttgcgttatcaaaatgaaaactgccaaatgaga

SEQ ID NO: 5483 - DNA, 50 bp, Homo sapiens
gctttgagttttgggatggtcacatgacacaatccagcacttgaacctga

SEQ ID NO: 5484 - DNA, 50 bp, Homo sapiens
agagccattcccacaaagtaaatgtgcagtgcccatgtttcttgtgttta

SEQ ID NO: 5485 - DNA, 50 bp, Homo sapiens
gactctgagagagagcgacggccatcatagaacagcgaaggcagtcgatc

SEQ ID NO: 5486 - DNA, 50 bp, Homo sapiens
atcgatgagaagagtctgcaaaacacttcatcctcaggacgtgctgtcct

SEQ ID NO: 5487 - DNA, 50 bp, Homo sapiens
atatattaaaccacaggtattagagacatgaattgcacccaacacaagct

SEQ ID NO: 5488 - DNA, 50 bp, Homo sapiens
attcattcgggtcttcctttcttccgcccccttccttccattggcacctc

SEQ ID NO: 5489 - DNA, 50 bp, Homo sapiens
tcagttttgtggaatctggtgtttgcactataggttaagagttgccattt

SEQ ID NO: 5490 - DNA, 50 bp, Homo sapiens
tgtgtggtgggggtgcttttgaggttggaggaaagtagagacagcgaaac

SEQ ID NO: 5491 - DNA, 50 bp, Homo sapiens
tgtgctttttgcccaagtggtaattcatcttggtttgctatgttaaaact

SEQ ID NO: 5492 - DNA, 50 bp, Homo sapiens
ctttggggacctaaaccccaggtggtctcttggtgttaataatgctggaa

SEQ ID NO: 5493 - DNA, 50 bp, Homo sapiens
aaatcgcggtcgccttaatccaagcctaggttttcacacttttagtaagc

SEQ ID NO: 5494 - DNA, 50 bp, Homo sapiens
tggggcactttgaaaacttcacaggcccactgctgcttgctgaaataaaa

SEQ ID NO: 5495 - DNA, 50 bp, Homo sapiens
gacattcatctgtttccactgagtctgagtcttcaagttttcactccagc

SEQ ID NO: 5496 - DNA, 50 bp, Homo sapiens
tggcgaggataaatagaggcattgtttttgctactttgcatatcattggc

SEQ ID NO: 5497 - DNA, 50 bp, Homo sapiens
tggctctcctctttgtaatatacagggtgaactctttactgatacacaca

SEQ ID NO: 5498 - DNA, 50 bp, Homo sapiens
ccagtgtcctgcatgggtgctaggctgaattatttgtaattgtgcttagg

SEQ ID NO: 5499 - DNA, 50 bp, Homo sapiens
accgtcttttgtgattccctggaaacccttaattcaatagtcctgactga

SEQ ID NO: 5500 - DNA, 50 bp, Homo sapiens
agccctgggtagccaagtgattttcccattcccaaagttagtaaaccttt

SEQ ID NO: 5501 - DNA, 50 bp, Homo sapiens
gcaggaaagatggggtggtggactgtttttgcctactttttgtttttgaa

SEQ ID NO: 5502 - DNA, 50 bp, Homo sapiens
ccccctgaaactggcattttgtaaatgtggtttgactatttttgtatgtt

SEQ ID NO: 5503 - DNA, 50 bp, Homo sapiens
acctggagaattccctaaggccaaagcaaggtaacagggacttcagtttt

SEQ ID NO: 5504 - DNA, 50 bp, Homo sapiens
gcctcagtacaaagggggctttggaagtgtttgttggctgaataaaggaa

SEQ ID NO: 5505 - DNA, 50 bp, Homo sapiens
acccatgccaattgaagaacgtgttaaagatgaggaggagagatgtacca

SEQ ID NO: 5506 - DNA, 50 bp, Homo sapiens
gcacattccttccttatatcctggaagcacccagatattcttcatgtccc

SEQ ID NO: 5507 - DNA, 50 bp, Homo sapiens
ttaagtcatctgctgagcagtgtgctgtgtcaacctcctcctaggtaacc

SEQ ID NO: 5508 - DNA, 50 bp, Homo sapiens
cagggtatcagatattgtgccttttggtgccaggttcaaagtcaagtgcc

SEQ ID NO: 5509 - DNA, 50 bp, Homo sapiens
tggtaatagtgtttgactccagggaagaacagatgggtgccagagtgaaa

SEQ ID NO: 5510 - DNA, 50 bp, Homo sapiens
tcaagtataccatttaaaatatttcatcaggcagagccctgaccaggaaa

SEQ ID NO: 5511 - DNA, 50 bp, Homo sapiens
cttttccggttgcccgaggatgcttgggaaggaacccgtctcccttcttc

SEQ ID NO: 5512 - DNA, 50 bp, Homo sapiens
tccccaaacccccttaaaggtttttaaattgtttcaaatctgggcaagtt

SEQ ID NO: 5513 - DNA, 50 bp, Homo sapiens
gactcggagagccaggaggagaacacgcagctctgaactggctgagcgag

SEQ ID NO: 5514 - DNA, 50 bp, Homo sapiens
ctgttgtgaatcatttgtgtccttttcaactgtctttcagaggaaaggta

SEQ ID NO: 5515 - DNA, 50 bp, Homo sapiens
aagaagcaaccacagctaattttagaacatgcactctgacagaaaagaca

SEQ ID NO: 5516 - DNA, 50 bp, Homo sapiens
gcttttgaggacctttctggaggaaaggaaaagcctgttttggggagtct

SEQ ID NO: 5517 - DNA, 50 bp, Homo sapiens
aggctgcatatggattgccaagtcagcatatgaggaattaaagacattgt

SEQ ID NO: 5518 - DNA, 50 bp, Homo sapiens
aagactagagctacactaggccactatcttattacacgacagcacaacat

SEQ ID NO: 5519 - DNA, 50 bp, Homo sapiens
ttaagaaccccaaagattaaaggaaacaatgttaagggcttttgtgagga

SEQ ID NO: 5520 - DNA, 50 bp, Homo sapiens
cggaagtcgaaatcaaatctatgcttttaattgaaaccgtgcctgaaacg

SEQ ID NO: 5521 - DNA, 50 bp, Homo sapiens
tcttcaccaggttcaagctccgtgggccacactgctgctgtgccaagaag

SEQ ID NO: 5522 - DNA, 50 bp, Homo sapiens
gatacactgtccagcccaggtccaggccctaggttctttactctagctac

SEQ ID NO: 5523 - DNA, 50 bp, Homo sapiens
tggaatttactaaattgtgaaattaacgtaaccgaagcaacaaccggcaa

SEQ ID NO: 5524 - DNA, 50 bp, Homo sapiens
gcgggaggctgggactttccattacaaatagagacttcattcctgttgag

SEQ ID NO: 5525 - DNA, 50 bp, Homo sapiens
actcaggtggtgctggtgttagtgatgctggagaagagaatattactggt

SEQ ID NO: 5526 - DNA, 50 bp, Homo sapiens
caggttgctttcgtgtccctcttctggttgctttagaagtgacgtgtaat

SEQ ID NO: 5527 - DNA, 50 bp, Homo sapiens
aaacacagcccaccccatttcagaccgccttcctgaggagaaaatgacag

SEQ ID NO: 5528 - DNA, 50 bp, Homo sapiens
gctaactggataaagtttgtgcagacattcctgagtgtacgatattgacc

SEQ ID NO: 5529 - DNA, 50 bp, Homo sapiens; identical to SEQ ID NO: 5528

SEQ ID NO: 5530 - DNA, 50 bp, Homo sapiens
agctggcttcactgctcaggtgattatcctgaaccaccaggccaaataag

SEQ ID NO: 5531 - DNA, 50 bp, Homo sapiens
agtcaggactgtctaggtcagggaagccaagatgtctgaagagagaggaa

SEQ ID NO: 5532 - DNA, 50 bp, Homo sapiens
attcaaccagtaatggtacctgaggaattgaaatgggtatttgtttctgt

SEQ ID NO: 5533 - DNA, 50 bp, Homo sapiens
agtggagaggccctgttagtttacttttcatattgagtgatgcatgaggt

SEQ ID NO: 5534 - DNA, 50 bp, Homo sapiens
gcattctatttaaaaagggagtggggagcaaatgaaaattaaatgtgggg

SEQ ID NO: 5535 - DNA, 50 bp, Homo sapiens
tcaccaggaaaacatgcttgtgaattgtgcagtaaaaggtggtaatgact

SEQ ID NO: 5536 - DNA, 50 bp, Homo sapiens
ccttttctctcccatgaccctttaacagcatctgcttcattcccctcacc

SEQ ID NO: 5537 - DNA, 50 bp, Homo sapiens; identical to SEQ ID NO: 1754

SEQ ID NO: 5538 - DNA, 50 bp, Homo sapiens
tgagtgaacaaagctgtgaaacattctgcgtttatgcaacttccttgcct

SEQ ID NO: 5539 - DNA, 50 bp, Homo sapiens
caagaagacaagcatctgtggtgcggaggcaagcaggctaactaggagtt

SEQ ID NO: 5540 - DNA, 50 bp, Homo sapiens
ttggcccagtgtgattgattgctttatctttggtacttttacttgaatgg

SEQ ID NO: 5541 - DNA, 50 bp, Homo sapiens
catccagcactaattttcatgcatttatgaaaggatgcctgaggaccctt

SEQ ID NO: 5542 - DNA, 50 bp, Homo sapiens
agcctgaggcaaataaaattccagtaatttcgaagaatgggtgttggcaa

SEQ ID NO: 5543 - DNA, 50 bp, Homo sapiens
aggaccttgacaagccgtttgagatggaatgtaggccctgatgttatgct

SEQ ID NO: 5544 - DNA, 50 bp, Homo sapiens; identical to SEQ ID NO: 5543

SEQ ID NO: 5545 - DNA, 50 bp, Homo sapiens
agtggagtgtttacaccttgctgtaacatttgaactttcacaagagatgt

SEQ ID NO: 5546 - DNA, 50 bp, Homo sapiens
atatcatattatttgatgccattaggcggcctggatcaccaattctaagt

SEQ ID NO: 5547 - DNA, 50 bp, Homo sapiens
gccaccagacagaaggaccagagtttctgattataaacaatgatgctggg

SEQ ID NO: 5548 - DNA, 50 bp, Homo sapiens
tgttggtgagcaatgtgcagaggcagagccgctgaagtatggttcctgag

SEQ ID NO: 5549 - DNA, 50 bp, Homo sapiens
ggctgctgttgactgaaattcctatcctcaaattactctagactgaagct

SEQ ID NO: 5550 - DNA, 50 bp, Homo sapiens
ctttttagtaggcaaaggttcttcttcctcctcttttggtgcagggacgc

SEQ ID NO: 5551 - DNA, 50 bp, Homo sapiens
gcgtgtatgtgggatgccataggtgtgactgtagagtcattcttccttcc

SEQ ID NO: 5552 - DNA, 50 bp, Homo sapiens
tgtaagttgactttcaaaagtctctggaaacactggactttagctggtcc

SEQ ID NO: 5553 - DNA, 50 bp, Homo sapiens
gaagcgtggcagagaactatggatcaggcagcccctctcatctttaccat

SEQ ID NO: 5554 - DNA, 50 bp, Homo sapiens
ttggtccaaactctggagccttgtgggagaacatagggcataacgtgttt

SEQ ID NO: 5555 - DNA, 50 bp, Homo sapiens
cccttcttagtaaagagacatcttctacagtaaccacagagaagaagtgg

SEQ ID NO: 5556 - DNA, 50 bp, Homo sapiens
tggacataacctgggtcagaagagaaacttttgaagctacacgaacaagc

SEQ ID NO: 5557 - DNA, 50 bp, Homo sapiens
cggctcaaataaacctttaccggatttttggggttatgcccacacccttg

SEQ ID NO: 5558 - DNA, 50 bp, Homo sapiens
ggaccactagtactccagaaccataatataactagacatgcctggaatgc

SEQ ID NO: 5559 - DNA, 50 bp, Homo sapiens
aacaagccatgtttgccctagtccaggattgcctcacttgagacttgcta

SEQ ID NO: 5560 - DNA, 50 bp, Homo sapiens; identical to SEQ ID NO: 4387

SEQ ID NO: 5561 - DNA, 50 bp, Homo sapiens
gagaaacttccgtgcatgaaggtttcctccttgactcggcagcagcggcc

SEQ ID NO: 5562 - DNA, 50 bp, Homo sapiens
ccaagtaggttttaactctggtatggtctcgtgttttcatttgttgtgca

SEQ ID NO: 5563 - DNA, 50 bp, Homo sapiens
gttcccacggagctgacttctccggggtgcctgtgccctacattaaaccc

SEQ ID NO: 5564 - DNA, 50 bp, Homo sapiens
ccgtaactccgacaaacgcagaacttcttgaggctttcttcttctaagga

SEQ ID NO: 5565 - DNA, 50 bp, Homo sapiens
tctggaccctgcttgggttcacagcattggtggaggtaagtagtattctc

SEQ ID NO: 5566 - DNA, 50 bp, Homo sapiens
gaagaggaagctcatccgaagtcttccgacagagtgagccgtcatgcccg

SEQ ID NO: 5567 - DNA, 50 bp, Homo sapiens
agtgtgtattcttgatgtttattggctcatgtggacagaaatgtacaggg

SEQ ID NO: 5568 - DNA, 50 bp, Homo sapiens
agatgaggctgctctgaagattcagtaattaggatggacagtcagctact

SEQ ID NO: 5569 - DNA, 50 bp, Homo sapiens
tgggctttggggttcagtttgttacctttggagacttatttaatgaaacc

SEQ ID NO: 5570 - DNA, 50 bp, Homo sapiens
cagtggttcctgagagaatcttagttcaaaggactgcccccgccaacccc

SEQ ID NO: 5571 - DNA, 50 bp, Homo sapiens
accgccaaagccaatcatccactttcagtacttacctaaccaatctccca

SEQ ID NO: 5572 - DNA, 50 bp, Homo sapiens
caggatgttattgacagggtggcctttgtgattcctccggtggtggcagc

SEQ ID NO: 5573 - DNA, 50 bp, Homo sapiens
gccatttcatttgctgtgtggttagacttccaggaggctgtttagctcta

SEQ ID NO: 5574 - DNA, 50 bp, Homo sapiens
cctttgtgaaaagtcacctgtgactgtcaggggtatgctatgggcctttt

SEQ ID NO: 5575 - DNA, 50 bp, Homo sapiens
gatccactttggggttcggcggcagattattccgctggtagagccggatg

SEQ ID NO: 5576 - DNA, 50 bp, Homo sapiens
aataagggactcattcattatgcagcaaatgttgtttgttattggcttgc

SEQ ID NO: 5577 - DNA, 50 bp, Homo sapiens
cttcatggtctccagccaggactccatcagcgccacggcttcatccgaac

SEQ ID NO: 5578 - DNA, 50 bp, Homo sapiens
ttgatgctcatcatctgctcgaggtgattgatgccaggttgacgcaccat

SEQ ID NO: 5579 - DNA, 50 bp, Homo sapiens
tcctttggataaggtccaaaacctgtaacacatgaccctcagagcccttt

SEQ ID NO: 5580 - DNA, 50 bp, Homo sapiens
cccggcgacttcaccacccgctatctgggcaccaaagactatatctagat

SEQ ID NO: 5581 - DNA, 50 bp, Homo sapiens
cgcaatagtcctcgacaagtcgccaaccctcccacttcggtcgatcagct

SEQ ID NO: 5582 - DNA, 50 bp, Homo sapiens
cgtcgggtacctcgccgataaaatcgctgatggcctggtcgatcctgaag

SEQ ID NO: 5583 - DNA, 50 bp, Homo sapiens
atcttatccctctgttactcaatgtgagtgcatactttacattgcctact

SEQ ID NO: 5584 - DNA, 50 bp, Homo sapiens
ggtccttgaagatgacgcggatgatcgaggtctctgcgccgtaggcgatg

SEQ ID NO: 5585 - DNA, 50 bp, Homo sapiens
atgatgaagctgctgtccaacgccttcgtctgccagtttctgctggtgtg

SEQ ID NO: 5586 - DNA, 50 bp, Homo sapiens
tccttgccagagccttcgggttctacgatttgatcgacgacgctggtgtc

SEQ ID NO: 5587 - DNA, 50 bp, Homo sapiens
tcgaacatgggcagctccgtttcaagatggctcaagactagcggattggg

SEQ ID NO: 5588 - DNA, 50 bp, Homo sapiens
agtgatagagaccaaagactgctttttaattttgtgggggagggggtgga

SEQ ID NO: 5589 - DNA, 50 bp, Homo sapiens
cgggtcactcatgttggctactaacccttttcgtgcgccgggcattctag

SEQ ID NO: 5590 - DNA, 50 bp, Homo sapiens
cttgtccttgatcgcttccttctctgcaagggagagcttctggaccttca

SEQ ID NO: 5591 - DNA, 50 bp, Homo sapiens
cttgtttgacatcagcgccatctcgacagcgtattccgctatgactgttt

SEQ ID NO: 5592 - DNA, 50 bp, Homo sapiens
cacgaagccttcgatcagttgcagcacgcggccagagcggtcgatagaac

SEQ ID NO: 5593 - DNA, 50 bp, Homo sapiens
cattttgccatctgcgagcatctgggtattgacatgatccccagtggagc

SEQ ID NO: 5594 - DNA, 50 bp, Homo sapiens
caccaagctggtcaacatccaggcgaatggctattacgtggatgagatca

SEQ ID NO: 5595 - DNA, 50 bp, Homo sapiens
ttgctgatacggcctttgatcatgttttcaacgatgttttccggcttgcc

SEQ ID NO: 5596 - DNA, 51 bp, Homo sapiens
cctcgacaaactaaatgttgatttgaattggcctgttatcatcttgatcac

SEQ ID NO: 5597 - DNA, 50 bp, Homo sapiens
gtttcagatcgggccgctcccgccgggtacctatagcggaatcgaatttc

SEQ ID NO: 5598 - DNA, 50 bp, Homo sapiens
gaaaacagaaatgatgctcggcacattctcgtccagcacctcggcaacgg

SEQ ID NO: 5599 - DNA, 50 bp, Homo sapiens
aactgtattcgatcaccgtggcgctgatggtgtcagcagtcgccttgttc

SEQ ID NO: 5600 - DNA, 51 bp, Homo sapiens
agttgacatataacccactttacatacattccaaaattgcgagtagtgagt

SEQ ID NO: 5601 - DNA, 50 bp, Homo sapiens
atatcgtaccgagaaactagtgcggatatctgaccaggtatggcggttgg

SEQ ID NO: 5602 - DNA, 50 bp, Homo sapiens
gtggatgacctgatccaggtcggcctgatcggcctgactgatgagctgtc

SEQ ID NO: 5603 - DNA, 50 bp, Homo sapiens
atgatgaccagatgctctggcaccgtgtcgagttcgaggatgccgacatt

SEQ ID NO: 5604 - DNA, 50 bp, Homo sapiens
gatctgggacgcatggccgaagctgaaaagctggctgtagaagacctcga

SEQ ID NO: 5605 - DNA, 50 bp, Homo sapiens
aacatggcaatatttattggtcctaatactgtcactggcaaggttggtgt

SEQ ID NO: 5606 - DNA, 50 bp, Homo sapiens
gaggcagaggtgtagcgagtccaggctctcttcgaacgttgcacccgacg

SEQ ID NO: 5607 - DNA, 50 bp, Homo sapiens
gtcccacacgttcggccctgactctgctgtgttcgacgaggacaatctcg

SEQ ID NO: 5608 - DNA, 50 bp, Homo sapiens
catgacgttgtgctcgacaccccaacagatcacgtaatcagcctggtgga

SEQ ID NO: 5609 - DNA, 51 bp, Homo sapiens
taggctatagagatgtgagggattattattagtcacacctctagtcatgcc

SEQ ID NO: 5610 - DNA, 50 bp, Homo sapiens
ggctgccggatgtgtaggtcttcccatgttgtgaagtaacggtgctccac

SEQ ID NO: 5611 - DNA, 50 bp, Homo sapiens
tgccctgtatagtgttgtaaaaattagaatgtttcacccaaaccatctgg

SEQ ID NO: 5612 - DNA, 50 bp, Homo sapiens
gtctttcgaatcgctctttagctcgtgcgggctgttgtcccacttgttgg

SEQ ID NO: 5613 - DNA, 50 bp, Homo sapiens
ctatgcgctgcgctacaagctggacctgtattcggacttcagctactacc

SEQ ID NO: 5614 - DNA, 50 bp, Homo sapiens
ttcgaagcgacgctgcgtgcgctgctcgtccaattgcagcatggataagg

SEQ ID NO: 5615 - DNA, 50 bp, Homo sapiens
ccttccgctgtcccttcagtagctgtttctgttccctgacgcccacttct

SEQ ID NO: 5616 - DNA, 50 bp, Homo sapiens
caatgcagcggctgatgcagatcacccacgagatgcaggacgaaggcgag

SEQ ID NO: 5617 - DNA, 50 bp, Homo sapiens
tcattcagtctgagtaggaggaaagaggacaggttgttggagagttggtt

SEQ ID NO: 5618 - DNA, 50 bp, Homo sapiens
taattgccgctgaagcacgaatcctcgaaatgcgtcaccttcggattgac

SEQ ID NO: 5619 - DNA, 50 bp, Homo sapiens
aaatgtggtgacaaagtaccagcaagaactggactgtgtttctggagcct

SEQ ID NO: 5620 - DNA, 50 bp, Homo sapiens
gttcatcgtctcgcgtcgcaagaagtaagggctaggccatgactcgttcg

SEQ ID NO: 5621 - DNA, 50 bp, Homo sapiens
ctcttggcagccctgctctcgtgggtcagcatcgtcgcgtgctccggtgg

SEQ ID NO: 5622 - DNA, 50 bp, Homo sapiens
gtgctcgctgagctggtccagaaatccgtcgactgaggcgatggcggctg

SEQ ID NO: 5623 - DNA, 50 bp, Homo sapiens
catgaacaagggccggatcatcctgatgcccaacacactggacttcggtg

SEQ ID NO: 5624 - DNA, 50 bp, Homo sapiens
cacccgttgtaggcgacgagcgtgaacgaaaacgtgtcggacggcttgta

SEQ ID NO: 5625 - DNA, 50 bp, Homo sapiens
catatgcggctgtgccatagccggatgttcttcgtgcgtgcctacccccg

SEQ ID NO: 5626 - DNA, 50 bp, Homo sapiens
ttctttccgtcgcgcatcggaatgcgaaactcgtacttcgtgtagaactc

SEQ ID NO: 5627 - DNA, 50 bp, Homo sapiens
gccaggggctttatcacttccatggccgcagcgatgaccaggtcaagctg

SEQ ID NO: 5628 - DNA, 50 bp, Homo sapiens
cgccgaccaagcttaccgacttctcgccgatctactgcgacgaagaaggc

SEQ ID NO: 5629 - DNA, 50 bp, Homo sapiens
ggtagtgacgtgctgaatgacggtgccgtccatcatcgggtcggagtaag

SEQ ID NO: 5630 - DNA, 50 bp, Homo sapiens
ttcaggactcgtttcacgtaggcaacgctgtctaaagttcccaagggatt

SEQ ID NO: 5631 - DNA, 50 bp, Homo sapiens
ctctttacccggaaacaggttggggagatgacacgcagaaaatcatacgc

SEQ ID NO: 5632 - DNA, 50 bp, Homo sapiens
ctttggatatatcgagaaaggccagggcctgaacaaggaaagcttccagg

SEQ ID NO: 5633 - DNA, 50 bp, Homo sapiens
aaggctggtcaagaatcttgagacggaattgcacagtctcggcgtgatcc

SEQ ID NO: 5634 - DNA, 50 bp, Homo sapiens
gatcgattcgggggtgacatcggcgctgagcaccatcaccggaacataag

SEQ ID NO: 5635 - DNA, 50 bp, Homo sapiens
ctgagatcaccctgaacaccgacaaggacgagatcgcagtctgcaacctg

SEQ ID NO: 5636 - DNA, 50 bp, Homo sapiens
ctgaaggctttggcgacaaccaggtctatccgtttgaaattggcgagaac

SEQ ID NO: 5637 - DNA, 50 bp, Homo sapiens
tcttgtgccagcacgtcttgctgatagccgatgaatcgcgtccctttgtc

SEQ ID NO: 5638 - DNA, 50 bp, Homo sapiens
gaactcctcaaggaaatagtccaccgcctgctgcttggacgctgccagtt

SEQ ID NO: 5639 - DNA, 50 bp, Homo sapiens
gtgacctcggggtcccccttggtgagggtgccggtcttgtcgaagacgac

SEQ ID NO: 5640 - DNA, 50 bp, Homo sapiens
gtgttcgggcttcatgtcgccaacaccatcggcactggcatcatcgatcc

SEQ ID NO: 5641 - DNA, 50 bp, Homo sapiens
aggttgatttccacttcctcgggaggtttcgccacctcttcgcctttgag

SEQ ID NO: 5642 - DNA, 50 bp, Homo sapiens
gttagcttccacgctttatctcctgctctgagtgtgtacccgcgctgctc

SEQ ID NO: 5643 - DNA, 50 bp, Homo sapiens
ttaaagtggtaagggaggtttctactcctggggaaacattaaagtacctt

SEQ ID NO: 5644 - DNA, 50 bp, Homo sapiens
ctttctccgacttcgagatctgcccgtggtcgagatcgtggtagatgatg

SEQ ID NO: 5645 - DNA, 50 bp, Homo sapiens
aactggatagagcacgagccttctaagcttggagttgcaggttcgaatcc

SEQ ID NO: 5646 - DNA, 50 bp, Homo sapiens
gaagatcggcgcaacgaagaccgcttccacttcatcaactggaccaagaa

SEQ ID NO: 5647 - DNA, 50 bp, Homo sapiens
tgcttctgtgacagattagcttacatcttaccacctcaccgagaagagct

SEQ ID NO: 5648 - DNA, 50 bp, Homo sapiens
agctcaagagcttccgcgacgtacccagcaaagtaacgctcgacgaatgc

SEQ ID NO: 5649 - DNA, 50 bp, Homo sapiens
atcgaagacgtgatgctgaacctttgggcgaaggccgagaaggaaggcaa

SEQ ID NO: 5650 - DNA, 50 bp, Homo sapiens
cgataccctcactagacctcggatcgaaataaatcagagcgatcacatcg

SEQ ID NO: 5651 - DNA, 50 bp, Homo sapiens
ggggatacacaccccacaagccttcctgcggcttcatcacggttaccacc

SEQ ID NO: 5652 - DNA, 50 bp, Homo sapiens
gatcttggtgagaagctcggtcatgtagaagacctcgccctgggacacta

SEQ ID NO: 5653 - DNA, 50 bp, Homo sapiens
attttatcgccagctacgtcggcattggtcaggacgacctgaaggggaat

SEQ ID NO: 5654 - DNA, 50 bp, Homo sapiens
tgatgcggagagcgaggtagatcccggcggagttttcgtcgatgggaaag

SEQ ID NO: 5655 - DNA, 50 bp, Homo sapiens
gtacacttcctggatctgatccacgaggtaacgagcgagagtggtgatac

SEQ ID NO: 5656 - DNA, 50 bp, Homo sapiens
gtgacttcatgctcggggttgagcttggcgtccaccaccttttcccactc

SEQ ID NO: 5657 - DNA, 50 bp, Homo sapiens
ccggtgtccttgatcagcttcagcagtggcttgacgtagatgcgggtcgg

SEQ ID NO: 5658 - DNA, 50 bp, Homo sapiens
catcagtgtttctcctgctgggactgttgcatgtggtgcatcacggtttg

SEQ ID NO: 5659 - DNA, 50 bp, Homo sapiens
gcgaggcgaaacatagcttccattgtgtcttttctccttatgcgtcttgc

SEQ ID NO: 5660 - DNA, 50 bp, Homo sapiens
aatgagacccgccgtccctggagatgaagatgtcgtccgactccgtccac

SEQ ID NO: 5661 - DNA, 50 bp, Homo sapiens
cggatgttgtcgttccagaacgaaggatcggcctcttgggcctggatttc

SEQ ID NO: 5662 - DNA, 50 bp, Homo sapiens
ggcaccgacttgggcctgagagaggcgcaggtcatcaatatagaatcggg

SEQ ID NO: 5663 - DNA, 50 bp, Homo sapiens
ccatgctgaacttggccaggtccttgacggcggtgttttccgacagcacc

SEQ ID NO: 5664 - DNA, 50 bp, Homo sapiens
cgcgatgatctcgtccttcggcatggcgatgcgctattccttcgacatgg

SEQ ID NO: 5665 - DNA, 50 bp, Homo sapiens
gcccattgaccgtatcgcgtcatcttgctggcatttctaagaaaataccg

SEQ ID NO: 5666 - DNA, 50 bp, Homo sapiens
tgaaacagggaaaagccaggaagatctccggttccacgtccaatttgtac

SEQ ID NO: 5667 - DNA, 50 bp, Homo sapiens
caagaatgacggaaaaatccgtgagcacaaggcaaaggcttgccgtgtgg

SEQ ID NO: 5668 - DNA, 50 bp, Homo sapiens
gacttgatcacaacccgatccgtaacgacgtattggagccactcgaacaa

SEQ ID NO: 5669 - DNA, 50 bp, Homo sapiens
cttctcgccgtaacttttccgccgagcacgctacgcacgtaggtgttgtg

SEQ ID NO: 5670 - DNA, 50 bp, Homo sapiens
tcgactacgacttcaacttccccaaacggtgggagaagcgagcttgaggc

SEQ ID NO: 5671 - DNA, 50 bp, Homo sapiens
aagttgatcagatcacgggccacgcctgcaaccagaggcttgtcatcgtc

SEQ ID NO: 5672 - DNA, 50 bp, Homo sapiens
tgatctgattgtgaggagagtggagaaggtggtatagaagctgaaagggt

SEQ ID NO: 5673 - DNA, 50 bp, Homo sapiens
cttcatgctcgagaagaaaatgctccgtgcctccgacgacgccaccatcg

SEQ ID NO: 5674 - DNA, 50 bp, Homo sapiens
cagatggtcacgagacgcttgtccgtgatgtcttccgtcagcgtgcagag

SEQ ID NO: 5675 - DNA, 50 bp, Homo sapiens
tgatggatttggaaagtgttattctgtttgacttctccctgctctgctca

SEQ ID NO: 5676 - DNA, 50 bp, Homo sapiens
ttgaacgggtatagccaccaaggcattggctgcaaagtcgggcaaaactt

SEQ ID NO: 5677 - DNA, 50 bp, Homo sapiens
actgtgtattgatgagtatctgatgcctataacatctgtaggaggctaca

SEQ ID NO: 5678 - DNA, 50 bp, Homo sapiens
gtacgaaggtggcgatgatgcgttcgatcacctcggggatttcctcggcg

SEQ ID NO: 5679 - DNA, 50 bp, Homo sapiens
cgaccttcggcgtttccgcttcggaacccgtgaaggcgttcttcactttg

SEQ ID NO: 5680 - DNA, 50 bp, Homo sapiens
attcgctggcaacataattaccagactcacatcgaacgaagctcggttcc

SEQ ID NO: 5681 - DNA, 50 bp, Homo sapiens
tgttcgttgccatccttgtcgaggaacatctcgctttccagttccgcctg

SEQ ID NO: 5682 - DNA, 50 bp, Homo sapiens
tttgggggatccttttgtaatgacttacactggaaatgcgaacatttgca

SEQ ID NO: 5683 - DNA, 50 bp, Homo sapiens
ggacaaggggcacccggattatatttcccaccaatcctaatcctaaaccc

SEQ ID NO: 5684 - DNA, 50 bp, Homo sapiens
tggagcttattttggagaactgtcaccattttatcccagttggcaatttt

SEQ ID NO: 5685 - DNA, 50 bp, Homo sapiens
attatgggtaaggcttgggcttgttcccacatgttaaccaaatggcctca

SEQ ID NO: 5686 - DNA, 50 bp, Homo sapiens
gggagggccaaagaaatctttttcccgtttcaaattatgttccccaaaaa

SEQ ID NO: 5687 - DNA, 50 bp, Homo sapiens
ttaccccaatgcttttgccccggtggcccagtttgtaaattggtttgatt

SEQ ID NO: 5688 - DNA, 50 bp, Homo sapiens
ccccccttggcaggttaattggtgtttaaggaaccctccagggtgggggg

SEQ ID NO: 5689 - DNA, 51 bp, Homo sapiens
ccccccagttttaatgttagggggaagggatttaaccccttatttaaaaaa

SEQ ID NO: 5690 - DNA, 50 bp, Homo sapiens
ctatcacccttgatatgaaattccagaattttctgtgataccacatggcc

SEQ ID NO: 5691 - DNA, 50 bp, Homo sapiens
actccgggccttaatggatttggcctgtcctcaagaatggtaattatgaa

SEQ ID NO: 5692 - DNA, 50 bp, Homo sapiens
acgtggtttcagtccttagcaccgtggtattgacatgacatcagttgcaa

SEQ ID NO: 5693 - DNA, 50 bp, Homo sapiens
cacaacttgctgttcacgtctttggggtgttttccattcctaatagatgg

SEQ ID NO: 5694 - DNA, 50 bp, Homo sapiens
aaacccgtcctccattataattacctttcaaagggcaagtcaaaagttgt

SEQ ID NO: 5695 - DNA, 50 bp, Homo sapiens
aaacagcacaacatgagtgtttcctaccacatcaattttaatgaagacac

SEQ ID NO: 5696 - DNA, 50 bp, Homo sapiens
cggaatcgggtttccattggaccccaaaaatttccctttgggcttcatga

SEQ ID NO: 5697 - DNA, 50 bp, Homo sapiens
tgaggatagaagcagccttttatatttttgtgtggtaaagcaaattggca

SEQ ID NO: 5698 - DNA, 50 bp, Homo sapiens
ggggcaaatttcaagggacctccccaaagggggtgttttccctggatggg

SEQ ID NO: 5699 - DNA, 51 bp, Homo sapiens
aaacaggaagggggtttgggccctttgatcaactggaacctttggatcaag

SEQ ID NO: 5700 - DNA, 50 bp, Homo sapiens
actctttgtctttttaagacccctaatagccctttgtaacttgatggctt

SEQ ID NO: 5701 - DNA, 50 bp, Homo sapiens
ccggctgcctccatcccagaagagtgcgcagagaattaaatctagatatt

SEQ ID NO: 5702 - DNA, 50 bp, Homo sapiens
gggatgtaatacatatttttccaaataaaatgcctcatgggctttggggc

SEQ ID NO: 5703 - DNA, 50 bp, Homo sapiens; identical to SEQ ID NO: 4309

SEQ ID NO: 5704 - DNA, 50 bp, Homo sapiens
agttagtatacagccagaacagccaagcctcaattcttgtaccttgtgtc

SEQ ID NO: 5705 - DNA, 50 bp, Homo sapiens
ccctgatcctctgtagggaacttccttttctctaatcctagatcttttca

SEQ ID NO: 5706 - DNA, 50 bp, Homo sapiens
gaggcatcagaggttcaggagagttacaggcagcaggtgcggtataatat

SEQ ID NO: 5707 - DNA, 50 bp, Homo sapiens
tttgtttctttgggcctgatttgtatctctggaaggcattaattcttgaa

SEQ ID NO: 5708 - DNA, 50 bp, Homo sapiens
gctttgcctctcggaggagtcaaaggggcagtaactgtatggggtgagag

SEQ ID NO: 5709 - DNA, 50 bp, Homo sapiens
gctcccgaatattgtaatttgttgccccctatgtacccaaccccctgaaa

SEQ ID NO: 5710 - DNA, 50 bp, Homo sapiens
aggaagtatgagagttctgaaacccttgatagaaactggaagcctgccat

SEQ ID NO: 5711 - DNA, 50 bp, Homo sapiens
gacatagggttgcagtagtgagtgggcatctgttctcagaaggcagtgcc

SEQ ID NO: 5712 - DNA, 50 bp, Homo sapiens
ttctggccttgttcacctagaaacgctatttcctgtgttatggttctggc

SEQ ID NO: 5713 - DNA, 50 bp, Homo sapiens
gctctgggaaagagacagggaagtctggaatggaaaagaacacgatgaga

SEQ ID NO: 5714 - DNA, 50 bp, Homo sapiens
gggttacatttgagtctctgtacctgcttggaagaaataaaaatacgtgt

SEQ ID NO: 5715 - DNA, 50 bp, Homo sapiens
ctgggaatatgaagcgaacgccacacactagaacgcgccctgggagctgg

SEQ ID NO: 5716 - DNA, 50 bp, Homo sapiens
gctgcttttgcccatccaggtttccacatcctaatctttgcttttcttgt

SEQ ID NO: 5717 - DNA, 50 bp, Homo sapiens
tgtaaatgtggtttgactatttctgtatgtccccatctattgatgagggt

SEQ ID NO: 5718 - DNA, 51 bp, Homo sapiens; identical to SEQ ID NO: 5427

SEQ ID NO: 5719 - DNA, 50 bp, Homo sapiens
acataaactgtccctttaggaagaagcccaatgcccgattttgcccttta

SEQ ID NO: 5720 - DNA, 50 bp, Homo sapiens
ggacaagtggcatcggtactatatttcccaccaatcctaatcctaatccc

SEQ ID NO: 5721 - DNA, 50 bp, Homo sapiens
tatgtccctttttctcctcccttccccattccctggcatcatattgggac

SEQ ID NO: 5722 - DNA, 50 bp, Homo sapiens; identical to SEQ ID NO: 4876

SEQ ID NO: 5723 - DNA, 50 bp, Homo sapiens
tgtgggcttggtataaaccctactttgtgatttgctaaagcacaggatgt

SEQ ID NO: 5724 - DNA, 50 bp, Homo sapiens
ccgcctgaaacgggcattttgtaaatggggtttgactatttttgtatgtc

SEQ ID NO: 5725 - DNA, 50 bp, Homo sapiens
actggcaaatgaagcatactggcttgcagggaccttctgattcaagtaca

SEQ ID NO: 5726 - DNA, 50 bp, Homo sapiens
gaattcgatttgagatctgagggcagacccgaaccaggaaagcaactcag

SEQ ID NO: 5727 - DNA, 50 bp, Homo sapiens
aatgcaccaggctgccacctgcaccagtggttgctacatgggataagaaa

SEQ ID NO: 5728 - DNA, 50 bp, Homo sapiens
tatgataggattctccacagtggcttccgactcaggctccaatggaccaa

SEQ ID NO: 5729 - DNA, 50 bp, Homo sapiens
tgctgtatgggcaggttgtcttattatgtgatcaacagatgtccaggaac

SEQ ID NO: 5730 - DNA, 50 bp, Homo sapiens
acctccaagaacatctgcctttgttgaacgtgtttattacctgtccactc

SEQ ID NO: 5731 - DNA, 50 bp, Homo sapiens
ccttttgccccttagcccttggataatccggctgggaatgggggtgaggg

SEQ ID NO: 5732 - DNA, 50 bp, Homo sapiens
cccaaataagctctgtacttcggttacctatgtacctgttaccactttca

SEQ ID NO: 5733 - DNA, 50 bp, Homo sapiens
gccacatgtcctattctcacacaggtgctttaatttcagcccagtctcta

SEQ ID NO: 5734 - DNA, 50 bp, Homo sapiens
cttgaaggggctttgttgggtttttggggttttgggtgggactcccaaag

SEQ ID NO: 5735 - DNA, 52 bp, Homo sapiens
ggggttttaaaaattttcccgatttcaaaattaattttccgttgccccccgg

SEQ ID NO: 5736 - DNA, 50 bp, Homo sapiens
ccccctggggtttttgggaatgaggtaaggctttgaatttggtttgatat

SEQ ID NO: 5737 - DNA, 50 bp, Homo sapiens
acatgcttagagctggaggcttgaaaccataatcccaattaagtgctgtc

SEQ ID NO: 5738 - DNA, 50 bp, Homo sapiens
tgtttgtccaggaaaaggaagagggggaaattaaaacctttccggttagt

SEQ ID NO: 5739 - DNA, 50 bp, Homo sapiens
gcactgctccgtctagctgtatgacctttgttatgtttcttttcttccgt

SEQ ID NO: 5740 - DNA, 50 bp, Homo sapiens
cttcaatctgggctgggcactccacgcacataatcgtcactctcggagga

SEQ ID NO: 5741 - DNA, 50 bp, Homo sapiens
gcgggaagtgaaagcggaggctgggacaaggggaacttactgctcaaaaa

SEQ ID NO: 5742 - DNA, 50 bp, Homo sapiens
agtggtgtggtggcaataggaaaagaaaagatcaggatgagaaattgctt

SEQ ID NO: 5743 - DNA, 50 bp, Homo sapiens
ccaagggccttttggggttgtttcctataacttcagtattgtaaattagt

SEQ ID NO: 5744 - DNA, 50 bp, Homo sapiens
cataaaggggcattgccctagccggtccggcctttttccagtccatcctg

SEQ ID NO: 5745 - DNA, 51 bp, Homo sapiens
aggtttaagaaatttcccctaaatcttgtttggttggttgggatgaaaagt

SEQ ID NO: 5746 - DNA, 50 bp, Homo sapiens
aattgatcccattcttgctgaagtagacagtgccctcaagtggaattaaa

SEQ ID NO: 5747 - DNA, 50 bp, Homo sapiens
ctccaatgctgttatcccggctgggtcctcacactcccccaacaatccca

SEQ ID NO: 5748 - DNA, 50 bp, Homo sapiens
agaatgcgctatttccctcaaagccctggctgtaataaagaagccgattt

SEQ ID NO: 5749 - DNA, 50 bp, Homo sapiens
ctgaggtcagtgtggtttggtggaaggattatgatatttacaagctgagt

SEQ ID NO: 5750 - DNA, 50 bp, Homo sapiens
ggtcaatgttttgaaatttgtggagcaaaccccagttttatgcccttggt

SEQ ID NO: 5751 - DNA, 50 bp, Homo sapiens
agttggaaaatttagaaatgtccactgtaggacgtggaatatggcgtcga

SEQ ID NO: 5752 - DNA, 50 bp, Homo sapiens
ttcacgtcctaaagtgtggtagacgcgcccgcgaatttagtagtagtagg

SEQ ID NO: 5753 - DNA, 50 bp, Homo sapiens
ggacaagtggcatccgtattatatttcccaccattcctattcttaatccc

SEQ ID NO: 5754 - DNA, 50 bp, Homo sapiens
ggtctgcctcagtcttctactcatcagcaccacactgtcaaaatgttgga

SEQ ID NO: 5755 - DNA, 50 bp, Homo sapiens
agatgaattgaagcaaaaagttttcagtaccagcagcaaggcagaccccc

SEQ ID NO: 5756 - DNA, 50 bp, Homo sapiens
tcacctccacctctgagggagcaacgaatacaaaggtagacccccaaaag

SEQ ID NO: 5757 - DNA, 50 bp, Homo sapiens
ccccagccagcacttcccttttctgcgagggttttctgtttctttgatta

SEQ ID NO: 5758 - DNA, 50 bp, Homo sapiens
agaaaatttgaaccctacgcttctcccatcccacttcttactccatcccg

SEQ ID NO: 5759 - DNA, 50 bp, Homo sapiens
ctgtggcatcattcacaccaccagcagagtcccttccaagaggggtctgg

SEQ ID NO: 5760 - DNA, 50 bp, Homo sapiens
ccgtgttaaaaccaaagtttgggatttttcgggtattcattggaagtcac

SEQ ID NO: 5761 - DNA, 50 bp, Homo sapiens
cgagagcctggaagctttgcacactactgcctggaagatctgattctttg

SEQ ID NO: 5762 - DNA, 50 bp, Homo sapiens
tgttttaaaagtgggtttatttcaaccccttcactcccggttggtgaccg

SEQ ID NO: 5763 - DNA, 50 bp, Homo sapiens
tcttctctcagtcttcagcaagtagcttctttcagaactgcctcctcccg

SEQ ID NO: 5764 - DNA, 50 bp, Homo sapiens
gttttctgcatcccaaatgtcctggggcatgtgtcccttccttgctgacc

SEQ ID NO: 5765 - DNA, 50 bp, Homo sapiens
tgttatgattctctcaatttcataaagctcttctggcagaggagacagat

SEQ ID NO: 5766 - DNA, 50 bp, Homo sapiens
aaatggattacaatttccctgacatttgggcataaaacatctgccatcct

SEQ ID NO: 5767 - DNA, 50 bp, Homo sapiens
tcctccttccagagacctttgctttactgccattttttctgtgggctttt

SEQ ID NO: 5768 - DNA, 50 bp, Homo sapiens
aggcatagcagtagaatctgtcaaaaaggaggcatggaatgaaatgaacc

SEQ ID NO: 5769 - DNA, 50 bp, Homo sapiens
ctgaccctctcgcccctccacctgtgcttctgccctaggataacgctggg

SEQ ID NO: 5770 - DNA, 50 bp, Homo sapiens
gacccaaagaaaagatcaagaccgcatgtagcaaatgtagcaaggaggca

SEQ ID NO: 5771 - DNA, 50 bp, Homo sapiens
ctaatttcccactaaaaggtccagaaaaattgatgccacctgtagtttgg

SEQ ID NO: 5772 - DNA, 50 bp, Homo sapiens
gtaaagttccaagcgagtggaaggtaaatcacgactgtggcaccggagcc

SEQ ID NO: 5773 - DNA, 50 bp, Homo sapiens
gaaactgaatgaccatggaatgctgaaattccaaaagaaaaacgtcgcgc

SEQ ID NO: 5774 - DNA, 50 bp, Homo sapiens
tctctcaggtcgtcttcagagtccattccctttgtcttgatcttttctct

SEQ ID NO: 5775 - DNA, 50 bp, Homo sapiens
ctcccatcattccctcccgaaagccattttgttcagttgctcatccacgc

SEQ ID NO: 5776 - DNA, 50 bp, Homo sapiens
gccctgccccctacccttgccctttaaatttttgggactgaataaagaat

SEQ ID NO: 5777 - DNA, 50 bp, Homo sapiens
tgcaggataacttgctcatgaaaggaaatgccagattaaaccccttgcca

SEQ ID NO: 5778 - DNA, 50 bp, Homo sapiens
gccttcccttcgttcctttccaggcaataatgacatcattagtgatgcaa

SEQ ID NO: 5779 - DNA, 50 bp, Homo sapiens
cgccacggctccaatccctatatgagtgagcagtagaatcacataggaat

SEQ ID NO: 5780 - DNA, 50 bp, Homo sapiens
cctagaatcagactttaagcacaagcagggagggaaagcacttgagcagt

SEQ ID NO: 5781 - DNA, 50 bp, Homo sapiens
gcacatgcaaaaactcagatgtgcaaataactgttccctattaactacaa

SEQ ID NO: 5782 - DNA, 50 bp, Homo sapiens
ggtgctcaaactgtattttctccctccctccctccttctttctttccaga

SEQ ID NO: 5783 - DNA, 50 bp, Homo sapiens
ttcttccacgggatttctaattcattaaataggacctccacaccagacct

SEQ ID NO: 5784 - DNA, 50 bp, Homo sapiens
tatccagcctgacttcttcatgctgtactagccttccaatccttaactaa

SEQ ID NO: 5785 - DNA, 50 bp, Homo sapiens
tggacattgggggtcaaacccttttgtttaaattttccctttcccagggc

SEQ ID NO: 5786 - DNA, 50 bp, Homo sapiens
gctgtgccacggtcaggtggcttccaatctgtactcaattgttactgtac

SEQ ID NO: 5787 - DNA, 50 bp, Homo sapiens
tcagagatgctgatgtcatataagtagtttccctgtctggccttggatgt

SEQ ID NO: 5788 - DNA, 50 bp, Homo sapiens
gtatgactgatgatagctgcgaatgaggaggagggaagggaaggctggag

SEQ ID NO: 5789 - DNA, 50 bp, Homo sapiens
ccattgccccggtgttttggtttaattttcccaggcttattttaaaggcc

SEQ ID NO: 5790 - DNA, 50 bp, Homo sapiens
aggaaattaaacatgagcatgacatgaccccaactctcaagaaatcccca

SEQ ID NO: 5791 - DNA, 50 bp, Homo sapiens
atcaggtcccctacaaaattagctactttggcctttcctacaaaattagc

SEQ ID NO: 5792 - DNA, 50 bp, Homo sapiens
tcattcgtttgctttctctgactgacaggcagtaatgacttcaataagct

SEQ ID NO: 5793 - DNA, 50 bp, Homo sapiens
agggcctgcttcagagtttgtttcctaaataaaacaatggctctccccgt

SEQ ID NO: 5794 - DNA, 50 bp, Homo sapiens
cccccaacttacatggaaaagggatggttgcatttctgtgtcatatgcat

SEQ ID NO: 5795 - DNA, 50 bp, Homo sapiens
gcagagggaagaggaaatgctttgaagccttgctagttatttaattagtt

SEQ ID NO: 5796 - DNA, 50 bp, Homo sapiens
gacatagttgcaaaacacaatacttaatactttttctggaggagggggcc

SEQ ID NO: 5797 - DNA, 50 bp, Homo sapiens
accccttttcttaatttctcaggaaaatggcagctccttcttttgtcgtc

SEQ ID NO: 5798 - DNA, 50 bp, Homo sapiens
cctccggtgtcttcggaagcactgaagggacatctggggaccctcacctg

SEQ ID NO: 5799 - DNA, 50 bp, Homo sapiens
actctttgaccaataaatcactggaatagaggttccagcatattctgaga

SEQ ID NO: 5800 - DNA, 50 bp, Homo sapiens
atgcttacaccctggatgaataaagtctttatttacacctccacctcccc

SEQ ID NO: 5801 - DNA, 50 bp, Homo sapiens
ctcttcacaggtcataagcccctctgagcggcgacagtcctcgcatccag

SEQ ID NO: 5802 - DNA, 50 bp, Homo sapiens
cagctcgacctcagtccccttcagaaataagatggcggctgcgctgacag

SEQ ID NO: 5803 - DNA, 50 bp, Homo sapiens
tttcaacgtgtacctttcctgggaaaccatctcaataaacacattttggt

SEQ ID NO: 5804 - DNA, 50 bp, Homo sapiens
gctggacacatgggttaagaggaggaaaagtaggaaaggaggaggggaaa

SEQ ID NO: 5805 - DNA, 50 bp, Homo sapiens
ggctgggaccagggtttttcaagccaccttttcctgtctcagttcagaga

SEQ ID NO: 5806 - DNA, 50 bp, Homo sapiens
cccactttcacacatgactcacacgactgaaggaaagaaagggcatcctt

SEQ ID NO: 5807 - DNA, 50 bp, Homo sapiens
aagaaattaaggaaggcaagagggtaggtgttggcccatggaagtttccc

SEQ ID NO: 5808 - DNA, 50 bp, Homo sapiens
ctggcaaatattgcggaagatgtactgaaatgtaattgaaatgtagctgc

SEQ ID NO: 5809 - DNA, 50 bp, Homo sapiens
agcataagagatacgaagctgatggtaattaacttgtaccccttgaagtg

SEQ ID NO: 5810 - DNA, 50 bp, Homo sapiens
agtgtcagacaattagatactctttcctgtcttcaggagcccatctggaa

SEQ ID NO: 5811 - DNA, 50 bp, Homo sapiens
gaagtgtaaacatgccaacagggtttatatttaggttccaagagttgcca

SEQ ID NO: 5812 - DNA, 50 bp, Homo sapiens
cttcccaaactccattgtctcattctcactgcttatgttattgctcttat

SEQ ID NO: 5813 - DNA, 50 bp, Homo sapiens
cccacacagcagagaagtatcagaaaacatagaaacatgtgaaaatgcgc

SEQ ID NO: 5814 - DNA, 51 bp, Homo sapiens
aggttcaattcattttcctgagatgtttggtttataagatttgaggatggt

SEQ ID NO: 5815 - DNA, 50 bp, Homo sapiens
atacttagatgtgcttggatcctgggtgggaggcttggttagaagtcacg

SEQ ID NO: 5816 - DNA, 50 bp, Homo sapiens
tgggtcagcgtgttcaattttaaataggaatacactagccttacaacgga

SEQ ID NO: 5817 - DNA, 50 bp, Homo sapiens
tgttcatcttgatgtaatagagaaggaaagagagagcatcccttttcagt

SEQ ID NO: 5818 - DNA, 50 bp, Homo sapiens
accagtaacacaatgacggcaagcacagagaaggaaaaagtcagatcccc

SEQ ID NO: 5819 - DNA, 50 bp, Homo sapiens
acttggagctagagagccacccatcatatggaggagaagtggtcactcta

SEQ ID NO: 5820 - DNA, 50 bp, Homo sapiens
tgcatgtgtgttgtgtacttgtctgttctgtaagattgtcggtgttacac

SEQ ID NO: 5821 - DNA, 50 bp, Homo sapiens
ttcctggcagtaaagaaaagaaagaagatgtgagttatgaagcattgact

SEQ ID NO: 5822 - DNA, 51 bp, Homo sapiens
aaataggaatataatctgtccacatcaaagaatgggaagtcgaagtgtaca

SEQ ID NO: 5823 - DNA, 50 bp, Homo sapiens
gttccaaatgttttccgctaatagtttgtcctaaagcctttgccattcct

SEQ ID NO: 5824 - DNA, 50 bp, Homo sapiens
acagagaaggcttatttacgttgggaattacattaaggaaaagtggtgac

SEQ ID NO: 5825 - DNA, 50 bp, Homo sapiens
ccttcctcctatatcctgccttgaatagggatgtgataccttgagccatg

SEQ ID NO: 5826 - DNA, 50 bp, Homo sapiens
atatttgggtctctgtttaagatttcattgccgtggtagggagagttcca

SEQ ID NO: 5827 - DNA, 50 bp, Homo sapiens
tggatgccatgatgacaccaataagcaacccacagattaggggaaatact

SEQ ID NO: 5828 - DNA, 50 bp, Homo sapiens
ggggctgggagccaccaaaagggcctgctcttcggagaaatgctgaattc

SEQ ID NO: 5829 - DNA, 50 bp, Homo sapiens
aggcatcttgaaagttccataaagacagaagtaagggtcattcagtcatt

SEQ ID NO: 5830 - DNA, 50 bp, Homo sapiens
agctaaagccacggaactcaatgagatttatgcatggaaggaaacaggtt

SEQ ID NO: 5831 - DNA, 50 bp, Homo sapiens
tgttctctctcgaactctggagcacatcagctctctctgcataaactgtt

SEQ ID NO: 5832 - DNA, 50 bp, Homo sapiens
atctggaggatggcagtttgagaattaggactaagcccgtctcccctttg

SEQ ID NO: 5833 - DNA, 50 bp, Homo sapiens
cattagctctctaaacatttggcctaagggattcataggtgaagccttta

SEQ ID NO: 5834 - DNA, 50 bp, Homo sapiens
ggtaggatttatccttttcttcatgtgcaactgtataaactggcaaagca

SEQ ID NO: 5835 - DNA, 50 bp, Homo sapiens
agtcttatgggacagagcagctctccagtctaggatggtagaagattctt

SEQ ID NO: 5836 - DNA, 50 bp, Homo sapiens
gagtctgtacccctttctaataaactgctctggacacaatgaaccctgaa

SEQ ID NO: 5837 - DNA, 50 bp, Homo sapiens
ccatcggcaagccttggtgggttcatattcagtggcattagggattaagg

SEQ ID NO: 5838 - DNA, 50 bp, Homo sapiens
ccatttcttctggatcctctcctagttgtctttgtgtggacgcacaagcg

SEQ ID NO: 5839 - DNA, 50 bp, Homo sapiens
gatcctttgctgacactggtttctctcttattttgccccgccaataaaaa

SEQ ID NO: 5840 - DNA, 51 bp, Homo sapiens
tctgtctgaaacttcttttctctctgagaattaaattttccaatggaccgt

SEQ ID NO: 5841 - DNA, 50 bp, Homo sapiens
gatctgtgttttcctcccaaaagaagatcatctttccagaaaaagaggat

SEQ ID NO: 5842 - DNA, 50 bp, Homo sapiens
ttccatatgtcactgtatctgcctggcattaccccttcttaaaacacaca

SEQ ID NO: 5843 - DNA, 50 bp, Homo sapiens
gctcactaccacttcttcaaatccagctaaaagcatcacggcctcaatga

SEQ ID NO: 5844 - DNA, 50 bp, Homo sapiens
gtctggttgttagctttcccgatcctccacacattggaaacctaagcata

SEQ ID NO: 5845 - DNA, 50 bp, Homo sapiens
gggcaatggagccacagactctctaacttcaagaggtgtttcataggtgt

SEQ ID NO: 5846 - DNA, 50 bp, Homo sapiens
agctgaggtcagacaaaccacaacatatatgcagatttatcagcaataaa

SEQ ID NO: 5847 - DNA, 50 bp, Homo sapiens
cctgccagggttgttcggaagtcgcaggtccgaaaatctcctccgcatac

SEQ ID NO: 5848 - DNA, 50 bp, Homo sapiens
cttctctgaaatggtacgcctatacttgcatttctgagaagccaaacaaa

SEQ ID NO: 5849 - DNA, 50 bp, Homo sapiens
agttttctggctaagtcacctcttaaggagatccctgtaaaattcaccct

SEQ ID NO: 5850 - DNA, 50 bp, Homo sapiens
cagattaaaaaccccatcccggccctcaccgaggtgttacaactctgtcc

SEQ ID NO: 5851 - DNA, 50 bp, Homo sapiens
agcaaattactctgcctggaaataaaattctgtcacttcaagcatctcct

SEQ ID NO: 5852 - DNA, 50 bp, Homo sapiens
tccaggcactgtataggtggcgaggacacaatgataggcaaagtagtaca

SEQ ID NO: 5853 - DNA, 50 bp, Homo sapiens
acagacccaaacctcacagagtgaaaggggactttcctcacagagtgaaa

SEQ ID NO: 5854 - DNA, 51 bp, Homo sapiens
ttgcttcagacttttaacaacaatcctagaagccagaaaacaatgaagaaa

SEQ ID NO: 5855 - DNA, 50 bp, Homo sapiens
ttctgtcagggcttcaaaagagacttccatagttttgggaactggagtca

SEQ ID NO: 5856 - DNA, 50 bp, Homo sapiens
gatatattgaaggtcagaggcagagctaaacaggtgatgccactgggtct

SEQ ID NO: 5857 - DNA, 50 bp, Homo sapiens
aggctcttgttgagtattcctttgattcctgcttctgtctttttaaatca

SEQ ID NO: 5858 - DNA, 50 bp, Homo sapiens
acacaccaaaagaaatagaagagtctttttctgcccttggggaatctgca

SEQ ID NO: 5859 - DNA, 50 bp, Homo sapiens
acacccagcacccacagggaagaaataattccacagagctaagtattcca

SEQ ID NO: 5860 - DNA, 50 bp, Homo sapiens
tgtgcctgtgtgctccagcctcttcctatgtgtgtaacttcaataaaacc

SEQ ID NO: 5861 - DNA, 50 bp, Homo sapiens
accgagtgttaccgcaagaggtgtaaaaatccaggttcatgtttgcacac

SEQ ID NO: 5862 - DNA, 50 bp, Homo sapiens
tcctgattctcaaagtacccccttccctacaactctaacatgctttgtct

SEQ ID NO: 5863 - DNA, 50 bp, Homo sapiens
ccatgatttttccaatggacaagcactattaacatgggactgtatttcct

SEQ ID NO: 5864 - DNA, 50 bp, Homo sapiens
aatagaactgatagcccatgatgattggctggcagggttaaggaagtggg

SEQ ID NO: 5865 - DNA, 50 bp, Homo sapiens
tcccaggagagtcacatttctttttcactaaataaggaggggaagaaaaa

SEQ ID NO: 5866 - DNA, 50 bp, Homo sapiens
gggttacctcactttctaggttcccaagattcccaagttaaggaagcttt

SEQ ID NO: 5867 - DNA, 50 bp, Homo sapiens
aaagcgtccagtccccctaactcaaacacagaaacataacaattttacaa

SEQ ID NO: 5868 - DNA, 50 bp, Homo sapiens
cccagggctcctccacctgaaagaattgtcagggtttcagatcagctaaa

SEQ ID NO: 5869 - DNA, 50 bp, Homo sapiens
tggcctccacccattaaactgtctttgcctaagacaaataattcccagga

SEQ ID NO: 5870 - DNA, 50 bp, Homo sapiens
tgtactcctgatgcctgaaaatcgttaagtgaagacttatcacattaccg

SEQ ID NO: 5871 - DNA, 50 bp, Homo sapiens
atccttcagattgagctgggtgtcagcattcaattccacaaggctacctg

SEQ ID NO: 5872 - DNA, 50 bp, Homo sapiens
tggataagcaatatgttggactagtatgaaaatggcattcccagcagtga

SEQ ID NO: 5873 - DNA, 50 bp, Homo sapiens
tcactagcagaatatagtgggcatgaccagtatcctagtagagctgaccc

SEQ ID NO: 5874 - DNA, 50 bp, Homo sapiens
agtttctttcttacaatgggggtctgaaatccagggtttccacaccaggg

SEQ ID NO: 5875 - DNA, 50 bp, Homo sapiens
ccaaatacttagtgtagttgacttgtcttgggttgcactgtaaggcagag

SEQ ID NO: 5876 - DNA, 50 bp, Homo sapiens
caagagtttccatgcgtccagtgatgaccggaattaatcatgtatggtgt

SEQ ID NO: 5877 - DNA, 51 bp, Homo sapiens
gtttctaacccataagtgcctcatacatacattgctagtctaaagagcttt

SEQ ID NO: 5878 - DNA, 50 bp, Homo sapiens
accggctaattttgtaactggcttgtttgtaaaataaatccttcctgtgt

SEQ ID NO: 5879 - DNA, 50 bp, Homo sapiens
tggtgggactatgtgttattcttgtatacttgcagtgggtagatgtcact

SEQ ID NO: 5880 - DNA, 50 bp, Homo sapiens
acttccctacctcacaggttaggattcaaagtgtgtattcccccattgtg

SEQ ID NO: 5881 - DNA, 50 bp, Homo sapiens
gggtgctttacaggattcttggaaatgtgtagtggatgctggctctaggg

SEQ ID NO: 5882 - DNA, 50 bp, Homo sapiens
acagaagcagggggtcagaaagtttcataaaggaggtgtcttggaacaaa

SEQ ID NO: 5883 - DNA, 50 bp, Homo sapiens
ctattgtgtgggttgccttgtcctactcaacttcaaatattcaccacccc

SEQ ID NO: 5884 - DNA, 50 bp, Homo sapiens
caggtgtgcttactggcaggaaccgagggaataaataaagatcactggaa

SEQ ID NO: 5885 - DNA, 50 bp, Homo sapiens
accagccttatgtgtgtgggtattcaatactctgcacattatatactgta

SEQ ID NO: 5886 - DNA, 50 bp, Homo sapiens
gggcatttgttaccccctcctcaccaccatccccattaaaggcttcgggg

SEQ ID NO: 5887 - DNA, 50 bp, Homo sapiens
ctgtatctacaactcctgacttcagatttttgctttcttcaaaacagcct

SEQ ID NO: 5888 - DNA, 50 bp, Homo sapiens
agcaagacttaaccactaattactattatctgacccaggaaaactccgcc

SEQ ID NO: 5889 - DNA, 50 bp, Homo sapiens
tggatagttgctcaatgtagcagtgatgttcttggaattgccagcagagc

SEQ ID NO: 5890 - DNA, 50 bp, Homo sapiens
ccaacagattcgtgcttaccctgaggtgaagcctcgtttgagaaccaaat

SEQ ID NO: 5891 - DNA, 50 bp, Homo sapiens
caaccttcttgttgaattgatttactactcatcagggtcatgcacaagca

SEQ ID NO: 5892 - DNA, 50 bp, Homo sapiens
acattcaaactgccagaatatgactgtaaaacagcgaagtgttctcttgc

SEQ ID NO: 5893 - DNA, 50 bp, Homo sapiens
tcttcctgggaatgtgatgtgtttttcactggttctaattctgtcttcct

SEQ ID NO: 5894 - DNA, 50 bp, Homo sapiens
acttattaattctcacctcagcctcagggatgtatgtagggaaggagcat

SEQ ID NO: 5895 - DNA, 50 bp, Homo sapiens
acattcctgtcattagtgaataagaagctgaggtgtgactaagaagacaa

SEQ ID NO: 5896 - DNA, 52 bp, Homo sapiens
cctccttgataaaatcaagaacaggttagattaaagcagtaaatcctagact

SEQ ID NO: 5897 - DNA, 50 bp, Homo sapiens
tcctggcctttgtgggtttttaattccctttaccttttccctttttggat

SEQ ID NO: 5898 - DNA, 50 bp, Homo sapiens
actgctgcaactacaattctcagatagtcccatttgtttaaatcacgcat

SEQ ID NO: 5899 - DNA, 50 bp, Homo sapiens
ccttccctcttgcctgtaggttctgtggctataaacaaatcataactttt

SEQ ID NO: 5900 - DNA, 50 bp, Homo sapiens
ttaaatgcttccctggctctccctgggtttcagtttctatccatgccctg

SEQ ID NO: 5901 - DNA, 50 bp, Homo sapiens
ttgttctcctcccaagtctctggttctatttggctttttcagctctgtgc

SEQ ID NO: 5902 - DNA, 50 bp, Homo sapiens
gcatttcagggacacaaatggtccatggcagagaccagtaatgccagata

SEQ ID NO: 5903 - DNA, 50 bp, Homo sapiens
ttttatccccgctttaactttgtttgcttggtacttttcttgtggttaca

SEQ ID NO: 5904 - DNA, 50 bp, Homo sapiens
cacgcacccaactccccactgctcctctccatccagatgttcgtccagag

SEQ ID NO: 5905 - DNA, 50 bp, Homo sapiens
tttgagggcaatttaatggttaagtgtaggaaaatccactcttacagtgt

SEQ ID NO: 5906 - DNA, 50 bp, Homo sapiens
ggccttttgattttccattggggtcccccgctttcccatttttggttttt

SEQ ID NO: 5907 - DNA, 50 bp, Homo sapiens
gacagtttggggaagggattgaaggtctgcgtcaaagagaacagaaaacc

SEQ ID NO: 5908 - DNA, 51 bp, Homo sapiens
aggggccttttaccggtttgttttcccttaaatttttaaaggaattgaatt

SEQ ID NO: 5909 - DNA, 50 bp, Homo sapiens
tcctctttcttgtcactgtgaagcgatgaataaacctgggtgtagatcca

SEQ ID NO: 5910 - DNA, 50 bp, Homo sapiens
cctagaaattattatacagggataaatgaggcactgaaggtgggagaacc

SEQ ID NO: 5911 - DNA, 50 bp, Homo sapiens
acgacaaactgcacagtaaatatcacaaacacggaaataccacagtgtct

SEQ ID NO: 5912 - DNA, 50 bp, Homo sapiens
accatgacttggcaaagagtttcaagagagggcataatcaaaagtaacca

SEQ ID NO: 5913 - DNA, 50 bp, Homo sapiens
gattaatcaagggaagagcttcaagcagagctccttaggtttttcaaaaa

SEQ ID NO: 5914 - DNA, 50 bp, Homo sapiens
gctcaggggacagctattctttttcaaagcgtttaccgactggatcacct

SEQ ID NO: 5915 - DNA, 50 bp, Homo sapiens
tgagagctttccttcctcctacgatccaaccatgtcaaacatttcctaca

SEQ ID NO: 5916 - DNA, 50 bp, Homo sapiens
tgtgccaacgcatgatttctttgagtaaatttctaaacgtcacagaagtt

SEQ ID NO: 5917 - DNA, 50 bp, Homo sapiens
agtcaacatggagcaagtgagctaaggaagtaatggaaactgtttggaga

SEQ ID NO: 5918 - DNA, 50 bp, Homo sapiens
agctcaggtcttccctcatctgttagtttcctggagtctgttctcatact

SEQ ID NO: 5919 - DNA, 50 bp, Homo sapiens
aaacatactcctcttcaccagcactcagacatttgtatccagagaaagct

SEQ ID NO: 5920 - DNA, 50 bp, Homo sapiens
agtctgtcaattgtttaagcctgtgatctttcttttcccagttaagagtt

SEQ ID NO: 5921 - DNA, 50 bp, Homo sapiens
tgtcctctcaaccctacttgtggttttacactgttaattacactatttgc

SEQ ID NO: 5922 - DNA, 50 bp, Homo sapiens
gtgtgtgtatggttgttgggcgtaggacaggtttcggggatgcgcggtac

SEQ ID NO: 5923 - DNA, 50 bp, Homo sapiens
ctgtgcttgactattgaaaacttagaattgggatgccaaagttacttcct

SEQ ID NO: 5924 - DNA, 50 bp, Homo sapiens
ggttgtatcaaaagaactccacatccatattgaataaactcccactagcc

SEQ ID NO: 5925 - DNA, 50 bp, Homo sapiens
ggctgcccagatctcgtgggaagaagaccacaggaggactcggctcaatg

SEQ ID NO: 5926 - DNA, 50 bp, Homo sapiens
tggaaaaatgatagcagccaacttgacagaagaacccagcatacacattc

SEQ ID NO: 5927 - DNA, 50 bp, Homo sapiens
ttggttttggggattgggaagtcttaagccaaattgtccccggtctcccc

SEQ ID NO: 5928 - DNA, 50 bp, Homo sapiens
gccctatatctagtgagcaggttgtggcaatcaggaagggattgatattt

SEQ ID NO: 5929 - DNA, 50 bp, Homo sapiens
tgcacgcaatgcttgaagtgttcccaggtatttagtttcaggtaaatttt

SEQ ID NO: 5930 - DNA, 50 bp, Homo sapiens
ctgtaggtatgagctgccaggatccaggtgtgactcgggtatttctaggg

SEQ ID NO: 5931 - DNA, 50 bp, Homo sapiens
tcccatttggggggtgggctgtttaaattttgactccctgttttaaaccc

SEQ ID NO: 5932 - DNA, 50 bp, Homo sapiens
ccacttgcatctcttctgggggttctttcctttctttcctgttctaaggc

SEQ ID NO: 5933 - DNA, 50 bp, Homo sapiens
tgggtaatcaacactcaaccatcaacaaacactctctattccaggcactg

SEQ ID NO: 5934 - DNA, 50 bp, Homo sapiens
aggagaaataattagagtggcacactagcatgatggtaaacattctgtca

SEQ ID NO: 5935 - DNA, 50 bp, Homo sapiens
aggagttcaagaagcagagatttccaggtccatgcaccaaagctcatgtg

SEQ ID NO: 5936 - DNA, 50 bp, Homo sapiens
cttgtcctctcctgatccagggctccagtgcccatgtccagtgccttggt

SEQ ID NO: 5937 - DNA, 50 bp, Homo sapiens
gcatctccccgctgtcagcctcagccctctcctaccaaaatctctttcga

SEQ ID NO: 5938 - DNA, 50 bp, Homo sapiens
ggcgtttcccattgaccagtttgaccctggtttgaataaagagaagtgcg

SEQ ID NO: 5939 - DNA, 50 bp, Homo sapiens
agcccattgaaaaccttggcaaaatgtcagaccttaagactttccactat

SEQ ID NO: 5940 - DNA, 50 bp, Homo sapiens
tcagagacaacggaagctgaaaaataagagctgagaaaggaagaactttt

SEQ ID NO: 5941 - DNA, 50 bp, Homo sapiens
atatacatacaaatctaagctccaagaagcctaagaaaaccccttagggg

SEQ ID NO: 5942 - DNA, 50 bp, Homo sapiens
gggcaatttacatcgggactcgtttcatctctagaccttcacttacctga

SEQ ID NO: 5943 - DNA, 50 bp, Homo sapiens
agctctggagtgcccctccctccaaataaagtattttaagcgaacactga

SEQ ID NO: 5944 - DNA, 50 bp, Homo sapiens
gccagtctctatgtgtcttaatcccttgtccttcattaaaagcaaaacta

SEQ ID NO: 5945 - DNA, 50 bp, Homo sapiens
ccctcaggcatagaaattgaatctgaaatggctgatgaataagcaaaggc

SEQ ID NO: 5946 - DNA, 50 bp, Homo sapiens
cagccctgcctgagtttttgacacctgcatccctccctgcctcacctcac

SEQ ID NO: 5947 - DNA, 50 bp, Homo sapiens
agagcaggagaaatcctactgcattattaatctgaaagcacaaggacagc

SEQ ID NO: 5948 - DNA, 50 bp, Homo sapiens
ctgtcttggtttgtatgggaaaatctgcgggttgtggaatattaggttct

SEQ ID NO: 5949 - DNA, 50 bp, Homo sapiens
tgggattatagggggagacaggagttgtggaattacaggagaggttcact

SEQ ID NO: 5950 - DNA, 50 bp, Homo sapiens; identical to SEQ ID NO: 5949

SEQ ID NO: 5951 - DNA, 50 bp, Homo sapiens
ctgagaaaaggagtgtctctcttctgctcccaaacttccagtagcttcca

SEQ ID NO: 5952 - DNA, 50 bp, Homo sapiens
tcgaggttcttcccaagaaaagcccaatcttataaactgttacttcccct

SEQ ID NO: 5953 - DNA, 50 bp, Homo sapiens
tgcaatgaggcagtggggtaaggttaaatcctctaaccgtctttgaatca

SEQ ID NO: 5954 - DNA, 50 bp, Homo sapiens
tggcaacttcaactccttgatggcgataatctctggtatgaatatgagcc

SEQ ID NO: 5955 - DNA, 50 bp, Homo sapiens
ttgtgctcctgatacgacgttgccacagttaatccgttctgatctctgct

SEQ ID NO: 5956 - DNA, 50 bp, Homo sapiens
caagcctaactttccaacactcccgcgacgcaaccccttcccctttcctc

SEQ ID NO: 5957 - DNA, 50 bp, Homo sapiens
cacggttagagtcaccaaacctgtatttcaggggacatctttccagctcc

SEQ ID NO: 5958 - DNA, 50 bp, Homo sapiens
ccaaaggctcactacccctgtgcgttgtccagcacacagacactatgtgc

SEQ ID NO: 5959 - DNA, 50 bp, Homo sapiens
tgcttgggaaatttggtttgtaaacctaaaatagcccttatttctgggga

SEQ ID NO: 5960 - DNA, 50 bp, Homo sapiens
catctgctgagcagtgtgctgtgtcaacctcctcctaggtctcctctatg

SEQ ID NO: 5961 - DNA, 50 bp, Homo sapiens
ctttctgcctgaagctgcccccatgactcccttctttgtgcaaaagcatg

SEQ ID NO: 5962 - DNA, 50 bp, Homo sapiens
gaaatgagttggtgtcttcacagaatgaggatccccagagccatcttgcc

SEQ ID NO: 5963 - DNA, 50 bp, Homo sapiens
gtctccctcccactctctgccttacctggtatctatgactcgactgaaat

SEQ ID NO: 5964 - DNA, 50 bp, Homo sapiens
tgcgagaggaagcagagaccaccttgaaactcgggtgcattaagtccttg

SEQ ID NO: 5965 - DNA, 50 bp, Homo sapiens
ttagccactgctattctaggttccttgatggagccccactcccacgccta

SEQ ID NO: 5966 - DNA, 50 bp, Homo sapiens
accacccagaggttgctggcttccttaataaagctaactttcctttcacc

SEQ ID NO: 5967 - DNA, 50 bp, Homo sapiens
aggggagccagtggtttttggtcatgggaagtgttctcataaaattcatt

SEQ ID NO: 5968 - DNA, 50 bp, Homo sapiens
gcaccagacttctgaacaggctgggagagtgaggcataaacacatgaaat

SEQ ID NO: 5969 - DNA, 50 bp, Homo sapiens
acacagtactttgttgagatgttggcttcttggtttatggcatgaattct

SEQ ID NO: 5970 - DNA, 50 bp, Homo sapiens
acttatcttttgccacccatgttcctggatgccttgccttcctctttcat

SEQ ID NO: 5971 - DNA, 50 bp, Homo sapiens
aaacaggaagcctctcatgaatttgaccaaggagctacattcgttctcta

SEQ ID NO: 5972 - DNA, 50 bp, Homo sapiens
tgaggaagaggagatttattaagccccttcttttaggctaggaggtttcc

SEQ ID NO: 5973 - DNA, 50 bp, Homo sapiens
ggacactggcttttgtgcagctcttcatcacagagtctgttgagctacaa

SEQ ID NO: 5974 - DNA, 50 bp, Homo sapiens
acagtgattttcaaccaaggggctttttcaaactacattccttagctccc

SEQ ID NO: 5975 - DNA, 50 bp, Homo sapiens
ggtggtggctacaagggtgattgccttatgataattgaccgtgtcataat

SEQ ID NO: 5976 - DNA, 50 bp, Homo sapiens
agctgggaggccattactttttgtctgagtcttctggagttctagcaaaa

SEQ ID NO: 5977 - DNA, 50 bp, Homo sapiens
agttgcattaaactgagcttagatgtgtaagtttgctaacggatgggttt

SEQ ID NO: 5978 - DNA, 50 bp, Homo sapiens
cctctaaggcatttatttactgacaacataaaatcttgaaccccaggtca

SEQ ID NO: 5979 - DNA, 50 bp, Homo sapiens
tcacctccatcaacttactagcacataaagggtgggatttcatgtgttga

SEQ ID NO: 5980 - DNA, 50 bp, Homo sapiens
ctggcaaaggcatgggtacaacctgctctgtgatctaccttctgaaccac

SEQ ID NO: 5981 - DNA, 50 bp, Homo sapiens
acacctgtggtatatttgtatcattcagtctggtttctcacccttcctaa

SEQ ID NO: 5982 - DNA, 50 bp, Homo sapiens
aaccctcgtaaggtttcatcttccttgattgcaaaatgagtttgtgtgaa

SEQ ID NO: 5983 - DNA, 50 bp, Homo sapiens
cccgcttcaccttccctaaataactcgtttgcaggctaattccatcaaat

SEQ ID NO: 5984 - DNA, 50 bp, Homo sapiens
attttgctcattacctgtcaggagaaaaccctccttccccagtctccact

SEQ ID NO: 5985 - DNA, 50 bp, Homo sapiens
acctactgaatctccagattgccaagtgaaacacaatggttgcctcttca

SEQ ID NO: 5986 - DNA, 50 bp, Homo sapiens
tgcgaaagctaattccctagtatgaataaacttcagaccttgctctcctt

SEQ ID NO: 5987 - DNA, 50 bp, Homo sapiens
agcctgaggtgggtgaagaaaatacctgctttatactgttctggaaactc

SEQ ID NO: 5988 - DNA, 50 bp, Homo sapiens
cttttccccttcatggtagttgctgcttaagtttctctaacatgcctgca

SEQ ID NO: 5989 - DNA, 50 bp, Homo sapiens
tgaatgtgcagatgcagaacccattgatatggagggctgagtgtctgaaa

SEQ ID NO: 5990 - DNA, 51 bp, Homo sapiens
tgtactacttatttatgtgtaaaccatacacagggctagaaaggaagggat

SEQ ID NO: 5991 - DNA, 50 bp, Homo sapiens
tgtagaattgcggagtagaaagacccttgaaagatcatttgtcctgtggt

SEQ ID NO: 5992 - DNA, 50 bp, Homo sapiens
gctcaagttcccagcacctggggaattctaagcctgaggaagacaaggtg

SEQ ID NO: 5993 - DNA, 50 bp, Homo sapiens
tgtttttatgtcctgagcaagcaaattgctgcaattaaaatcaccaattt

SEQ ID NO: 5994 - DNA, 51 bp, Homo sapiens
aggcctgatattgaaagcttttgatactgagatcctattaatctcagatga

SEQ ID NO: 5995 - DNA, 50 bp, Homo sapiens
tgttagtttgcttttgaaattctttggagggtactcttcagggcttcaca

SEQ ID NO: 5996 - DNA, 51 bp, Homo sapiens
tagtgattatctccaggaatcaagtacaaactttgaaaaaagactggaggt

SEQ ID NO: 5997 - DNA, 50 bp, Homo sapiens
tttgtcccaagggctcagactgaaagaatgcaatgtgagaggtatgccac

SEQ ID NO: 5998 - DNA, 50 bp, Homo sapiens
tctgtgaaaatctttctgcaaatgtctttgcttgcttgtactcacgtttt

SEQ ID NO: 5999 - DNA, 50 bp, Homo sapiens
tgtctttaacgcacagatgttacttcagcaccacaaggactgttgatgga

SEQ ID NO: 6000 - DNA, 50 bp, Homo sapiens
cagtcagatgttggaattgggggtagagggattatagagttgtgtgtgct

SEQ ID NO: 6001 - DNA, 50 bp, Homo sapiens
aaaggagggactatggcatcaaacagcctcttcagcacagtgacaccatg

SEQ ID NO: 6002 - DNA, 50 bp, Homo sapiens
acccagtttgtgcatagttcatgatcctctataaaaccagcttttgtgga

SEQ ID NO: 6003 - DNA, 50 bp, Homo sapiens; identical to SEQ ID NO: 4877

SEQ ID NO: 6004 - DNA, 50 bp, Homo sapiens
tggaatggactcttaaaacaatgaaagagcatttatcgtttgtcccttga

SEQ ID NO: 6005 - DNA, 50 bp, Homo sapiens
tcactaccttcaattgtttacaaggtggatatgggcaggcaacagatact

SEQ ID NO: 6006 - DNA, 50 bp, Homo sapiens
ctaggccggatgggccagagaaggagaaccatggcaggagccggaagcag

SEQ ID NO: 6007 - DNA, 50 bp, Homo sapiens
aaatgttgagcaactgttcaataacagcactaattgtgtgttcattggct

SEQ ID NO: 6008 - DNA, 50 bp, Homo sapiens
ctggcacatccaggttttagagcaggcagcctgagatttcaaaaatgagg

SEQ ID NO: 6009 - DNA, 50 bp, Homo sapiens
ggagcggaatacagtaaaagcactggactgacctaagagtttgtttctgc

SEQ ID NO: 6010 - DNA, 50 bp, Homo sapiens
acaccatttcagcgttggatcacagacagctcttcctttatatcccagca

SEQ ID NO: 6011 - DNA, 50 bp, Homo sapiens
ccaccttgctgccttttgaaacactcaggaaatatagttggctaaaactg

SEQ ID NO: 6012 - DNA, 50 bp, Homo sapiens
cacttcgcaacggagtgtttgaaattgtggtggtcctgatttataggatt

SEQ ID NO: 6013 - DNA, 50 bp, Homo sapiens
gctttggcagatggattaaccttgttcttttggagccagatcaatatcta

SEQ ID NO: 6014 - DNA, 50 bp, Homo sapiens
agaatgcctggttttcgtttgcaatttgcttgtgtaaatcaggttgtaaa

SEQ ID NO: 6015 - DNA, 50 bp, Homo sapiens; identical to SEQ ID NO: 1006

SEQ ID NO: 6016 - DNA, 50 bp, Homo sapiens
tgcaagtggatggtttggtatcactgtaaataaaaagagggcctgggaaa

SEQ ID NO: 6017 - DNA, 50 bp, Homo sapiens
gtggcttttctgttgacgccaaaggttactccctctgcctcaccataaaa

SEQ ID NO: 6018 - DNA, 50 bp, Homo sapiens
acctcctacgtctgttttctggctgtggtgacttgggatttttaacctta

SEQ ID NO: 6019 - DNA, 50 bp, Homo sapiens
atcgttggattatctttgaacccccttgtgtggatcattttgagccgcct

SEQ ID NO: 6020 - DNA, 50 bp, Homo sapiens
agctccaaagtggtttgatgaccacaggctaaaattcatagtcttaaaat

SEQ ID NO: 6021 - DNA, 50 bp, Homo sapiens
tcagaaaggagaaaacacagaccaaagagaagtatctaagaccaaaggga

SEQ ID NO: 6022 - DNA, 50 bp, Homo sapiens
gcatcacgatttgtctacataagtccagttcatctcgcgtttgttttggc

SEQ ID NO: 6023 - DNA, 50 bp, Homo sapiens
atacagggttccatccagaaagcattcagtcagagcaagttaaagtcagt

SEQ ID NO: 6024 - DNA, 50 bp, Homo sapiens
aagtgccagattttgataatcaccagcctctcattcaactcctatgttgc

SEQ ID NO: 6025 - DNA, 50 bp, Homo sapiens
acccttggtcactggtgtttcaaacattctggcaagtcacatcaatcaag

SEQ ID NO: 6026 - DNA, 50 bp, Homo sapiens
agctctggagcctttgcttcctcaaatacgagcgggaactgcgttgagcg

SEQ ID NO: 6027 - DNA, 50 bp, Homo sapiens
aagttgtcctgtgctaaagcaagcgtgggatgatcctacctacctctagg

SEQ ID NO: 6028 - DNA, 50 bp, Homo sapiens
atttggacagatgcagaaggaactgttagtgagtcaagacaaacacatct

SEQ ID NO: 6029 - DNA, 50 bp, Homo sapiens
cccctacccctggaaagtaatatactgaagtctcatcatactgttttggg

SEQ ID NO: 6030 - DNA, 50 bp, Homo sapiens; identical to SEQ ID NO: 1043

SEQ ID NO: 6031 - DNA, 50 bp, Homo sapiens
agctagtgatgttttgtccaaaggaagattctgacaacagcttcagcaga

SEQ ID NO: 6032 - DNA, 50 bp, Homo sapiens
acacagacatattgaccgcacacaacactgaaatggactgacttgagaaa

SEQ ID NO: 6033 - DNA, 50 bp, Homo sapiens; identical to SEQ ID NO: 4348

SEQ ID NO: 6034 - DNA, 50 bp, Homo sapiens
ggtccatgtcaccgtgagtacacccctatgattggtttgttgtcaagaag

SEQ ID NO: 6035 - DNA, 50 bp, Homo sapiens
tgctagttcaggtcctccaggcattgatttgtacagttaaactccgagtg

SEQ ID NO: 6036 - DNA, 50 bp, Homo sapiens; identical to SEQ ID NO: 4210

SEQ ID NO: 6037 - DNA, 50 bp, Homo sapiens
ggcctactgaccaaattgttgtgttgagatgatatttaactttttgccaa

SEQ ID NO: 6038 - DNA, 50 bp, Homo sapiens; identical to SEQ ID NO: 4297

SEQ ID NO: 6039 - DNA, 50 bp, Homo sapiens
cgatagaattgaagcagtccacggggaggggatgatacaaggagtaaacc

SEQ ID NO: 6040 - DNA, 50 bp, Homo sapiens
atagactccaaagaggcgttaagcacctggttttcctttggctcagaaaa

SEQ ID NO: 6041 - DNA, 50 bp, Homo sapiens
ctcaaacgaaattgggcaggccatttgcgtggtttctctggataagttcc

SEQ ID NO: 6042 - DNA, 50 bp, Homo sapiens
gcacatgacagtaagcgaggttttgggtaaatatagatgaggatgcctat

SEQ ID NO: 6043 - DNA, 50 bp, Homo sapiens
tcccagagtaactgacagtatcaaatagcaagagagttaggatgaggact

SEQ ID NO: 6044 - DNA, 50 bp, Homo sapiens
acacaggaaccgcttacccaccagctctgcccgcgtctctaccgccatag

SEQ ID NO: 6045 - DNA, 50 bp, Homo sapiens
ttcttccaagagaataaccctattaaaggctaaaaatggaagctcccagt

SEQ ID NO: 6046 - DNA, 50 bp, Homo sapiens
actgacctagcagatgtgtggaaaaggaatcagatcttgattcttctggg

SEQ ID NO: 6047 - DNA, 50 bp, Homo sapiens
acaactcaagtgaaaagatgtctccagtttctgaagataacgcacgctga

SEQ ID NO: 6048 - DNA, 50 bp, Homo sapiens
cgccgactcgttgaaagttttgttgtgtagttggttttcgttgagttctt

SEQ ID NO: 6049 - DNA, 50 bp, Homo sapiens
cacccacctggtaggaaggtcaatcttatgctcagaagtcccacccacca

SEQ ID NO: 6050 - DNA, 50 bp, Homo sapiens
caactccttaaagggttgaaggttgtgacaataactgagggaactgatgt

SEQ ID NO: 6051 - DNA, 50 bp, Homo sapiens
aaaacactccacctaaaagcaggaaagatggcaattctaaatagcagcta

SEQ ID NO: 6052 - DNA, 53 bp, Homo sapiens
ggaggttttgatcgtgactttattttgagatattgtatctttgttagtattgc

SEQ ID NO: 6053 - DNA, 50 bp, Homo sapiens
ttgtaaggttccggggaactgactcaacatggttctccaactcgaggttg

SEQ ID NO: 6054 - DNA, 50 bp, Homo sapiens
tgtgagtgttataggttacagtggattccaaactagccacaagtgaagca

SEQ ID NO: 6055 - DNA, 50 bp, Homo sapiens
tcagccaggaggaaaagcactctgattatgaattgagcagaaggaaacaa

SEQ ID NO: 6056 - DNA, 50 bp, Homo sapiens
gttcccactcgttcttgccggagaaacctgccttttcaagcataattcaa

SEQ ID NO: 6057 - DNA, 50 bp, Homo sapiens
gggtccaagattattgattaatttgggcaccgcgagagctcgagtccccc

SEQ ID NO: 6058 - DNA, 50 bp, Homo sapiens
gaccacctgtaaagcaagtcctttcaagtttcactgcacatcccaaacca

SEQ ID NO: 6059 - DNA, 50 bp, Homo sapiens
tggtccactgtcactgtttctctgctgttgcaaatacatggataacacat

SEQ ID NO: 6060 - DNA, 50 bp, Homo sapiens
agactctggaaaaggagggtcggagtattaaactggctgggaatgagagg

SEQ ID NO: 6061 - DNA, 50 bp, Homo sapiens
tgagagcacaccataaattcacagcaggaataaacgaagacacacgagca

SEQ ID NO: 6062 - DNA, 50 bp, Homo sapiens
acattctctcattttgctgaagctgatttgattgggtgtctgtttctcgc

SEQ ID NO: 6063 - DNA, 50 bp, Homo sapiens
tgagaaggtaaagtagaaagggaagatgatgagtgaacaataagccttgt

SEQ ID NO: 6064 - DNA, 50 bp, Homo sapiens
acattattccatgggaataagtcatcagtgcaaaggactgtaaggagtgc

SEQ ID NO: 6065 - DNA, 50 bp, Homo sapiens
cgccgctcctggagacctgataacttaggcttgaaataattgacttgtct

SEQ ID NO: 6066 - DNA, 50 bp, Homo sapiens
tgtatgtgcaatatgcttatgggtaattatgggcaagagaaatggaaaca

SEQ ID NO: 6067 - DNA, 50 bp, Homo sapiens
accccttggtaaagcagttgtaagaattaaacaagaggaattgctctttc

SEQ ID NO: 6068 - DNA, 50 bp, Homo sapiens
aaatcaggccccttgcgccattcacaaaaatccttgtgagatgactcaag

SEQ ID NO: 6069 - DNA, 50 bp, Homo sapiens
agggcagaggtcctttgggagggtaagctcacaaaaactcagggaggcag

SEQ ID NO: 6070 - DNA, 50 bp, Homo sapiens
tcatctccgccaaggttcccactaggcaggaaaggatttttatctaaagt

SEQ ID NO: 6071 - DNA, 50 bp, Homo sapiens
ccacccaagtcggaatccgagtgaaataaatagcatcgcccgccaactac

SEQ ID NO: 6072 - DNA, 50 bp, Homo sapiens
aggcacacgattgtcaccatttctccctttacaagctgtataatcagtaa

SEQ ID NO: 6073 - DNA, 50 bp, Homo sapiens
gcaacgtctgaatgtagtaatgtgactcagagcttcaaagtaagcattcg

SEQ ID NO: 6074 - DNA, 50 bp, Homo sapiens
gccaccccatctgggaggcccagcatccaattcagtcgccttcaatgatt

SEQ ID NO: 6075 - DNA, 50 bp, Homo sapiens
tgatagactggatgctgctatggtaatctgcctcaggaaaatgccggact

SEQ ID NO: 6076 - DNA, 50 bp, Homo sapiens
tggagccaagaagccactgactcaagaggatttcaagcgagagctgcttg

SEQ ID NO: 6077 - DNA, 50 bp, Homo sapiens
caacttttgtaacaggggacttagccgggggcaggaggggttcttgagac

SEQ ID NO: 6078 - DNA, 50 bp, Homo sapiens
acttgaaggcacatcttccttttggttgttttccatcttcaaattaaact

SEQ ID NO: 6079 - DNA, 51 bp, Homo sapiens
taaaaactgacatgacatgagatggtttaagtgtcaaacataagggtcttt

SEQ ID NO: 6080 - DNA, 50 bp, Homo sapiens
actgacataagcccacttcaggtgtttggaagacactaaagagaatcaga

SEQ ID NO: 6081 - DNA, 50 bp, Homo sapiens
gcagctttttgctggcgggggtctaaataaagtagcttccccaaaagaaa

SEQ ID NO: 6082 - DNA, 50 bp, Homo sapiens
acctggttatctcgcaatgacctagctaacacaaatgcaacatcagccgg

SEQ ID NO: 6083 - DNA, 50 bp, Homo sapiens
tgatcaaaatgaagatgctccaaccgtataaatggcagatgaaatagact

SEQ ID NO: 6084 - DNA, 50 bp, Homo sapiens
gcaggagagaaataccttctaatgggtgtggacactggaggaactgttac

SEQ ID NO: 6085 - DNA, 50 bp, Homo sapiens
agggcactgtttgttcctttaatatggagaaatatcgcaaataactggga

SEQ ID NO: 6086 - DNA, 50 bp, Homo sapiens
ttggcctatgttaatttctattctcagttcttctgtgcccttcctcctct

SEQ ID NO: 6087 - DNA, 50 bp, Homo sapiens
gaacgtaagcccgacgctaggcagtgctgttagaaagtgatttggaagag

SEQ ID NO: 6088 - DNA, 50 bp, Homo sapiens
atcccattctccctctcaaggcaggggtcatagatcctaagccataaaat

SEQ ID NO: 6089 - DNA, 50 bp, Homo sapiens
tgctgtaaaatggcagctccataggaacctattttccataggaacctgca

SEQ ID NO: 6090 - DNA, 50 bp, Homo sapiens
actggagaaaggtgtcttcctgtcctttcaggggctcctgcggggaattc

SEQ ID NO: 6091 - DNA, 50 bp, Homo sapiens
attatatttgtccctatcagaatcctcgaatccctagcagccagtccctg

SEQ ID NO: 6092 - DNA, 50 bp, Homo sapiens
tgctcactgtcttctggaagagacaagcactttcttgaaattcctaagca

SEQ ID NO: 6093 - DNA, 50 bp, Homo sapiens
caatcggatcattcttctcaacttgggcggctctttcctcccttccttcc

SEQ ID NO: 6094 - DNA, 50 bp, Homo sapiens
tgctttgggcagtagctgaagccgaagtatgaacagtccattttgtttct

SEQ ID NO: 6095 - DNA, 50 bp, Homo sapiens
cacagttgagtaggaggtcatgaagaagaagagatgatacctgccttacc

SEQ ID NO: 6096 - DNA, 50 bp, Homo sapiens
tttgtgtagcaaatgttcattaattgcctactttgtgccaaattcaggcc

SEQ ID NO: 6097 - DNA, 50 bp, Homo sapiens
tccagcattgtattgtctattgacacacaaagtttgaaaataaaggggca

SEQ ID NO: 6098 - DNA, 50 bp, Homo sapiens
cacccaccagaccgaggattccaaaagggggcgaaggcggagagcaaagg

SEQ ID NO: 6099 - DNA, 50 bp, Homo sapiens
tggactctgttttcaagaggaagaaacaactgacaaataagttgatgtca

SEQ ID NO: 6100 - DNA, 50 bp, Homo sapiens
atgttgaaactggttttaacttgtaatggtgtggctgatgttacccgacc

SEQ ID NO: 6101 - DNA, 50 bp, Homo sapiens
acacagatttgaagtctactgttctaaatggcctctacttcctgctgtca

SEQ ID NO: 6102 - DNA, 50 bp, Homo sapiens
ggaacttctgcttccacttacgatgaaggaacttgtactcaatccatcca

SEQ ID NO: 6103 - DNA, 50 bp, Homo sapiens
gaagccttcctgtggtcataacaagtctcacacaccccaaggactgatct

SEQ ID NO: 6104 - DNA, 50 bp, Homo sapiens
gagtccagcctttgaacctggcgctgaatcctgactttactgcttattca

SEQ ID NO: 6105 - DNA, 50 bp, Homo sapiens
aaactcatacatgcagaaaattgtctttgctcgaaatggtaatgccaaaa

SEQ ID NO: 6106 - DNA, 50 bp, Homo sapiens; identical to SEQ ID NO: 6105

SEQ ID NO: 6107 - DNA, 50 bp, Homo sapiens
acaaaagtcatggctgtgaggctatcattacccttttaccaaagttggaa

SEQ ID NO: 6108 - DNA, 53 bp, Homo sapiens
agttctatttctatcccaaactaagctatgtgaaataagagaagctactttgt

SEQ ID NO: 6109 - DNA, 50 bp, Homo sapiens
atcccgatggtgcccaccgctattaaaggttcgtttgttccacgattaaa

SEQ ID NO: 6110 - DNA, 50 bp, Homo sapiens
atgtctccatacccattacaatctccagcattccccctcaaacctaaaaa

SEQ ID NO: 6111 - DNA, 50 bp, Homo sapiens
gcccgtatttaccctatagcaccccctctaccccctttagagcccaaaaa

SEQ ID NO: 6112 - DNA, 50 bp, Homo sapiens
acattttcctccgcataagcctgcgtcagattaaaacactgaactgacaa

SEQ ID NO: 6113 - DNA, 50 bp, Homo sapiens
ccaagctggtttcaagccaaccccatggcctccatgactttttccaaaac

SEQ ID NO: 6114 - DNA, 50 bp, Homo sapiens
tgatcaggtgaaccggaagtctccaatttctgaatggattatgtttctaa

SEQ ID NO: 6115 - DNA, 50 bp, Homo sapiens
tgagtacgtgacacttgttgtagaatagtggtgttgagctatattcttgt

SEQ ID NO: 6116 - DNA, 50 bp, Homo sapiens
gtgacccttggcacccgctagaagtttatggccgagctttaccaattaaa

SEQ ID NO: 6117 - DNA, 50 bp, Homo sapiens
tgaactccaactttgaccaacccatgagacccctgttatccaaactttct

SEQ ID NO: 6118 - DNA, 50 bp, Homo sapiens
ccctctactatttggctccataacttaggacctgcctttcccggttccag

SEQ ID NO: 6119 - DNA, 50 bp, Homo sapiens
cccgtatttaccctatagcaccccctctaccccctttagagccccaaaaa

SEQ ID NO: 6120 - DNA, 50 bp, Homo sapiens
ccaactttcagaacagaagggtgggaaaccagaaccgcctgccatgcccc

SEQ ID NO: 6121 - DNA, 50 bp, Homo sapiens
gcgccagaaatccaatccagcccaaggatatagttaggattaattactta

SEQ ID NO: 6122 - DNA, 50 bp, Homo sapiens
ctgagattttgggttttccacacgggccaagatacccggcctctgctgag

SEQ ID NO: 6123 - DNA, 50 bp, Homo sapiens
atatcatttccacttagtattatacccacacccacccaagaacagggttt

SEQ ID NO: 6124 - DNA, 50 bp, Homo sapiens
acagcatgagaaactgttagtacgcatacctcagttcaaacctttaggga

SEQ ID NO: 6125 - DNA, 50 bp, Homo sapiens
gcttgccctagcagagtcatacggaataatggaaaactcaacttctgttc

SEQ ID NO: 6126 - DNA, 50 bp, Homo sapiens
cacaatgctgcctcctctgtggatgactgatggcaagagtctgaattgaa

SEQ ID NO: 6127 - DNA, 50 bp, Homo sapiens
cctctcactctcagactccaagggccaagaaaaactacggacaggaagcc

SEQ ID NO: 6128 - DNA, 50 bp, Homo sapiens
gagaggaggggtctcagacgttgggggacacactgctgggtgggtgattt

SEQ ID NO: 6129 - DNA, 50 bp, Homo sapiens
taagaaatcccaattttcaggagtggtggtgtcaataaacgctctgtggc

SEQ ID NO: 6130 - DNA, 50 bp, Homo sapiens
cggcagggtggcctgtaacaatttcagttttcgcagaacattcaggtatt

SEQ ID NO: 6131 - DNA, 50 bp, Homo sapiens
ggggctcccttcccggctttgttttctctgggagattttattttacctaa

SEQ ID NO: 6132 - DNA, 50 bp, Homo sapiens
gaaagtggagggagtggacggggaggagactagccagagaggctcattag

SEQ ID NO: 6133 - DNA, 50 bp, Homo sapiens
cttctcccctcttgccctctgtggtctgatttaaaacgaaaaggtcggat

SEQ ID NO: 6134 - DNA, 50 bp, Homo sapiens
ggacttctgaaatagagctggctccctggggtgacaatgtatatatgcaa

SEQ ID NO: 6135 - DNA, 50 bp, Homo sapiens
ctgggtgtcgtggaagatgacgaagatgctgggctggcagatgcagtcca

SEQ ID NO: 6136 - DNA, 50 bp, Homo sapiens
accagggcttaaaacctcaatttatgttcatgacagtggggatttttctt

SEQ ID NO: 6137 - DNA, 50 bp, Homo sapiens
attctccaaccacaaacagcacttctaaaactaactttactttctgccca

SEQ ID NO: 6138 - DNA, 50 bp, Homo sapiens
gatatagtctccataccccattaccatctcccagccattccccctccaac

SEQ ID NO: 6139 - DNA, 50 bp, Homo sapiens
tgatactttggttctctttcctgctcaggtcccttcatttgtactttgga

SEQ ID NO: 6140 - DNA, 50 bp, Homo sapiens
taatactggaggggcttgaagaaggctgtcgtgttttgtcacctgctttg

SEQ ID NO: 6141 - DNA, 50 bp, Homo sapiens
gtctttcccgtctttcttcctcacctatgtaatttcagtagtctctcagc

SEQ ID NO: 6142 - DNA, 50 bp, Homo sapiens
aggaagagcctgcacctgtggtggaacaatcagggaaaaggaagtcaaaa

SEQ ID NO: 6143 - DNA, 50 bp, Homo sapiens
tttggagcttctataggagtggagaggggcagctcattgttgagagttgc

SEQ ID NO: 6144 - DNA, 50 bp, Homo sapiens
tgatctgactggaaaacaatcctgtatcccctcccaaagaatcatgggct

SEQ ID NO: 6145 - DNA, 50 bp, Homo sapiens
tcatcccttaaacactctgtgatgggatcttcaggatcatcttttgaagt

SEQ ID NO: 6146 - DNA, 50 bp, Homo sapiens
tgcgtttggtttaggaatgtgcttttgtacttccacttgaataaaggtgt

SEQ ID NO: 6147 - DNA, 50 bp, Homo sapiens
tgctcagggcacatgcacacagacatttatctctgcactcacattttgtg

SEQ ID NO: 6148 - DNA, 50 bp, Homo sapiens
ggttattgctgacacgctgtcctctggcgacctgtcgctggagaggttgg

SEQ ID NO: 6149 - DNA, 50 bp, Homo sapiens
cgttttctgagcatccgttgtgccttaacattttctgcttgtcctttggg

SEQ ID NO: 6150 - DNA, 50 bp, Homo sapiens
cttctgaatgcccgagtcttctcttttgtgctcacaaatgccacccaatc

SEQ ID NO: 6151 - DNA, 50 bp, Homo sapiens
tgcttacaagggtgattgaccttgccttactctttatgtaaattatggca

SEQ ID NO: 6152 - DNA, 50 bp, Homo sapiens
ctggcgtattaccattttgatagcctctcttcaggctagataagctgggg

SEQ ID NO: 6153 - DNA, 50 bp, Homo sapiens
ccctgtattattgaaatgtcagcataatgactggaaggtgaaattggtcc

SEQ ID NO: 6154 - DNA, 50 bp, Homo sapiens
actgctgttgcatgaatagatgatacaaagcaagtgatgaggttggtatg

SEQ ID NO: 6155 - DNA, 50 bp, Homo sapiens
tggaagaacaaattcagacatcatcagtaagtctttagggacacagggaa

SEQ ID NO: 6156 - DNA, 50 bp, Homo sapiens
agtgaaaactggtacagtgttctgcttgatttacaacatgtaacttgtga

SEQ ID NO: 6157 - DNA, 50 bp, Homo sapiens
gccagaaagtgtgggctgaagatggttggtttcatgtttttgtattatgt

SEQ ID NO: 6158 - DNA, 50 bp, Homo sapiens
tgtcctctgaacctgagtgaagaaatatactctgtcctttgtacctgcgt

SEQ ID NO: 6159 - DNA, 50 bp, Homo sapiens
ccatttccactacatgcctttcctaccttcccttcacaaccaatcaagtg

SEQ ID NO: 6160 - DNA, 50 bp, Homo sapiens
acacttccctgaatgttgaagaagatatgctatccatgcaatccttgtcg

SEQ ID NO: 6161 - DNA, 50 bp, Homo sapiens
acttgtgtttgaaccacttctgcttcctctttaacctgagatgcacacgt

SEQ ID NO: 6162 - DNA, 50 bp, Homo sapiens; identical to SEQ ID NO: 6062

SEQ ID NO: 6163 - DNA, 50 bp, Homo sapiens
tgacagaatgaactggaaatgaaatcccacagttatgatcgtagtagagt

SEQ ID NO: 6164 - DNA, 50 bp, Homo sapiens
aagtacagatgccatcccggtgctgtgatcttccagccattctccatttc

SEQ ID NO: 6165 - DNA, 50 bp, Homo sapiens
actgccaatctgatttaaaattctccaagcttaattctgtgcaacaaaca

SEQ ID NO: 6166 - DNA, 50 bp, Homo sapiens
gcctgttgttctgtttatcgccctattttacaaaactgattctgacctgg

SEQ ID NO: 6167 - DNA, 50 bp, Homo sapiens
aactggcattgctaagccccagaaaaatgtatttagtggaacagatgaaa

SEQ ID NO: 6168 - DNA, 50 bp, Homo sapiens
acactaggtccttttatacctgtgcctttacgttcgttttcctgattgca

SEQ ID NO: 6169 - DNA, 50 bp, Homo sapiens
aatacagattcattttatttaagcgtccgtggcaccgacagggaccccag

SEQ ID NO: 6170 - DNA, 50 bp, Homo sapiens
agttcatcccctttcagaagctgtttgctcttggctcattaaacctgtga

SEQ ID NO: 6171 - DNA, 50 bp, Homo sapiens
gcctcttttcctgtatcacacaagggtcagggatggtggagtaaaagctc

SEQ ID NO: 6172 - DNA, 50 bp, Homo sapiens
tgttaggtggcctctgcatacctatgggaactcagtgatgtaatgcaaag

SEQ ID NO: 6173 - DNA, 50 bp, Homo sapiens
ctggggccgtagcaaaaatcatgaaaaacacttcaacgtgtcctttcaat

SEQ ID NO: 6174 - DNA, 50 bp, Homo sapiens
tgccaagtcagcagatttgctttatgaattacagggactagaaatgccca

SEQ ID NO: 6175 - DNA, 50 bp, Homo sapiens
ttgcatgtctcttcctaaatttcattgtgttgatttctaatccttcccgt

SEQ ID NO: 6176 - DNA, 50 bp, Homo sapiens; identical to SEQ ID NO: 4273

SEQ ID NO: 6177 - DNA, 50 bp, Homo sapiens
gaagtgacactgactgtatctacctctccttttcttcatcaggtgttcct

SEQ ID NO: 6178 - DNA, 50 bp, Homo sapiens; identical to SEQ ID NO: 5021

SEQ ID NO: 6179 - DNA, 50 bp, Homo sapiens
aattccaaaggagtgatgttggaatagtccctctaagggagagaaatgca

SEQ ID NO: 6180 - DNA, 50 bp, Homo sapiens
agcccctccaccccacccagtacttttacaatgtgttattaaagacccct

SEQ ID NO: 6181 - DNA, 50 bp, Homo sapiens
ccatccttgagaaatgtgggcaccaagtccataatctccataaatccaat

SEQ ID NO: 6182 - DNA, 50 bp, Homo sapiens
cgttgcattttcacatttgtgtggcaggacaagcatggggcaagagggac

SEQ ID NO: 6183 - DNA, 50 bp, Homo sapiens
tatgagtttatgcgttttcccagccctccgaatcactgactggggcgttt

SEQ ID NO: 6184 - DNA, 50 bp, Homo sapiens
ttgaaaagatgacatcgccccaagagccaaaaataaatgggaattgaaaa

SEQ ID NO: 6185 - DNA, 50 bp, Homo sapiens; identical to SEQ ID NO: 4224

SEQ ID NO: 6186 - DNA, 50 bp, Homo sapiens
tggtgatatctgcttagatttccctgtatctttgctgccctccttcaagt

SEQ ID NO: 6187 - DNA, 50 bp, Homo sapiens
agttggagctatctgtgcagcagtttctctacagttgtgcataaatgttt

SEQ ID NO: 6188 - DNA, 50 bp, Homo sapiens
cgtgggaggatgacaaagaagcatgagtcaccctgctggataaacttaga

SEQ ID NO: 6189 - DNA, 50 bp, Homo sapiens
gtggtttggtcagcatacacacttctcatttcatttgatgtacacagcca

SEQ ID NO: 6190 - DNA, 50 bp, Homo sapiens
acctgggatttcatttctgctgaaagaaataggaagaacaggactcactt

SEQ ID NO: 6191 - DNA, 50 bp, Homo sapiens
gggtgtgatgaatagcgaatcatctcaaatccttgagcactcagtctagt

SEQ ID NO: 6192 - DNA, 50 bp, Homo sapiens
agctttcaccacctcgcagttgtagagatagtccccgaaatattattcca

SEQ ID NO: 6193 - DNA, 50 bp, Homo sapiens
gtgtgaagtgacagccttgtgtgtgatgttttctgccttccccaagtttg

SEQ ID NO: 6194 - DNA, 51 bp, Homo sapiens; identical to SEQ ID NO: 5427

SEQ ID NO: 6195 - DNA, 50 bp, Homo sapiens
taagtggattggcagactccttgttgcttaagagtggctttctaggcagg

SEQ ID NO: 6196 - DNA, 51 bp, Homo sapiens; identical to SEQ ID NO: 5427

SEQ ID NO: 6197 - DNA, 50 bp, Homo sapiens; identical to SEQ ID NO: 5944

SEQ ID NO: 6198 - DNA, 50 bp, Homo sapiens; identical to SEQ ID NO: 6141

SEQ ID NO: 6199 - DNA, 50 bp, Homo sapiens
ggtccactctcactctttctctgctgttgcaaatacatggataacaccgt

SEQ ID NO: 6200 - DNA, 50 bp, Homo sapiens
cattcagtatttattgggaagacttgtcaagcaccatgataagtggtgga

SEQ ID NO: 6201 - DNA, 50 bp, Homo sapiens
agagggggaaggacttacatgacatcctactgggaatttgctagaaacca

SEQ ID NO: 6202 - DNA, 50 bp, Homo sapiens
ctggtgaagctgactccccaggtaaagagatatcagctctgcttcagact

SEQ ID NO: 6203 - DNA, 50 bp, Homo sapiens
ttgcttcttcctgctttatagagttcccgtaaaatacccttcaccctggc

SEQ ID NO: 6204 - DNA, 51 bp, Homo sapiens
tctgacctccgtgacgtttattaccagctgatgtcccgtacactgatttca

SEQ ID NO: 6205 - DNA, 50 bp, Homo sapiens
gggaagggtcagcaacgatttctcaccaaatcactacacagacacaaagg

SEQ ID NO: 6206 - DNA, 50 bp, Homo sapiens
accactaaatggttacactacaccaagacactaaaatggcagggagccct

SEQ ID NO: 6207 - DNA, 50 bp, Homo sapiens
aaattcaaatcacccttgatacccacttctttctcccacccaaatctgat

SEQ ID NO: 6208 - DNA, 51 bp, Homo sapiens
accatatcgtgcaaaatgtaatatggaatttccaaacatcaatgaagggat

SEQ ID NO: 6209 - DNA, 50 bp, Homo sapiens
aataagtaccgtatataaacacttctctttctctcctccacaatggcacg

SEQ ID NO: 6210 - DNA, 50 bp, Homo sapiens
agcatcactcttagaagaagcaactccttcccttgattctgtgtatttgg

SEQ ID NO: 6211 - DNA, 53 bp, Homo sapiens
tcaacccagaatctataatgtatgaaataaattaatagagaacccaacagatc

SEQ ID NO: 6212 - DNA, 50 bp, Homo sapiens
aaggtctccatctaacaggtagagcagttggtgcagatgagatgagcctg

SEQ ID NO: 6213 - DNA, 50 bp, Homo sapiens
ggtgatgataccacctccaatgaacagggaagcaagttcatcagtcaaca

SEQ ID NO: 6214 - DNA, 50 bp, Homo sapiens
agctgttggggctgcactgagctgcaatttttaacatggatttataactt

SEQ ID NO: 6215 - DNA, 50 bp, Homo sapiens
aaggaatttgttttccctatcctaactcagtaacagagggtttactccga

SEQ ID NO: 6216 - DNA, 50 bp, Homo sapiens
cgcacacattttctgtatggacaaatcctggattggcttcgttatttggt

SEQ ID NO: 6217 - DNA, 50 bp, Homo sapiens
ggtaatgaaacaatcatccagttaacaatcagcaaggttcttcagagcct

SEQ ID NO: 6218 - DNA, 51 bp, Homo sapiens
tggaagagtggactgaagaaagaacttatactctccctcctctaaaattga

SEQ ID NO: 6219 - DNA, 50 bp, Homo sapiens
tcctgggctattggctttatgatatcttttgagaaacaggattttcactt

SEQ ID NO: 6220 - DNA, 50 bp, Homo sapiens
accttttaaggatgtcttatttccaccccaactctccactccattttagt

SEQ ID NO: 6221 - DNA, 50 bp, Homo sapiens
gaaccttcaaaactgtcactttgagttccagaagagtccttcagcatctt

SEQ ID NO: 6222 - DNA, 50 bp, Homo sapiens
gtatttgggcttctccaagcagatcacgcagacgacggtgctacatttga

SEQ ID NO: 6223 - DNA, 50 bp, Homo sapiens
caagcatactggttctttccaagctcactgttctcaccacacggccccac

SEQ ID NO: 6224 - DNA, 50 bp, Homo sapiens
tccatatccatttctgacgttgaaccatttgacagtgccaaggactttgg

SEQ ID NO: 6225 - DNA, 50 bp, Homo sapiens
aagcctgtttttcactctaaaaattcaagaggacacgctaagaacgatca

SEQ ID NO: 6226 - DNA, 50 bp, Homo sapiens; identical to SEQ ID NO: 4276

SEQ ID NO: 6227 - DNA, 50 bp, Homo sapiens
gcgcacatggctattttgatacacaaagttgtgtttgctactttagaagc

SEQ ID NO: 6228 - DNA, 50 bp, Homo sapiens
aactcacgacaattgctacaaaacaccagggaggggctttttgtgttttt

SEQ ID NO: 6229 - DNA, 50 bp, Homo sapiens; identical to SEQ ID NO: 6141

SEQ ID NO: 6230 - DNA, 50 bp, Homo sapiens
gccctggtatgtatgcctttctctcctactgtctaatagcacctcgtaaa

SEQ ID NO: 6231 - DNA, 50 bp, Homo sapiens
aagaaaccgtggaagatactggtttatttcaaatgagcagagtatgttgt

SEQ ID NO: 6232 - DNA, 50 bp, Homo sapiens
ccacctcttctgacatgaatgtagcataagttagcaatcggttcttccaa

SEQ ID NO: 6233 - DNA, 50 bp, Homo sapiens
aggttccctttcaaataaagataaagaatttgacttgggacactgccaga

SEQ ID NO: 6234 - DNA, 50 bp, Homo sapiens
ggctggcctcattttgaaaagttagtacaattttcttcagtgctaacttg

SEQ ID NO: 6235 - DNA, 50 bp, Homo sapiens
actccagaacgtcagaaatggtgtagcagaatgaattctgttataaggaa

SEQ ID NO: 6236 - DNA, 50 bp, Homo sapiens
ctgttcgaaagttggagactgcctgtacccaggttgatagtcaattgttt

SEQ ID NO: 6237 - DNA, 50 bp, Homo sapiens
ccaccttgagcgccttcttctggttggttgtcatgcagttctcacacatg

SEQ ID NO: 6238 - DNA, 50 bp, Homo sapiens
acccttcccctttttcatatcctttcttcaaaaatctaaatgatgtgcct

SEQ ID NO: 6239 - DNA, 50 bp, Homo sapiens
agttccaggaggtggttttaaatattggatgaaaacttacaggctgtttt

SEQ ID NO: 6240 - DNA, 50 bp, Homo sapiens
acaatacatttacaaagccatctttacatgcattaaacgagggctacaac

SEQ ID NO: 6241 - DNA, 50 bp, Homo sapiens; identical to SEQ ID NO: 6240

SEQ ID NO: 6242 - DNA, 50 bp, Homo sapiens
ggcctgaagaaggagataagtgttccattcggcaacataagagaagttaa

SEQ ID NO: 6243 - DNA, 50 bp, Homo sapiens
tccatcccaaaggagagctactgtactgactgtacttgtggaatgcagcg

SEQ ID NO: 6244 - DNA, 50 bp, Homo sapiens
acccaccactctcaggaccacctgaaggcagaataaaccggatcctgttg

SEQ ID NO: 6245 - DNA, 50 bp, Homo sapiens
aaattgtgtgagaaggctgataaacgtctgtggtttctccctgtgctatt

SEQ ID NO: 6246 - DNA, 51 bp, Homo sapiens
gctgggcttctgcaaaattataaagttgctttattaaattcatacatgcgg

SEQ ID NO: 6247 - DNA, 51 bp, Homo sapiens
agctgattcattcattctatgtgtgccactaaataaagagattgagcaagt

SEQ ID NO: 6248 - DNA, 50 bp, Homo sapiens
cttgaagctgtgttggtggcctgtgaccttccaatgcaatctagactgtg

SEQ ID NO: 6249 - DNA, 50 bp, Homo sapiens
ctcatacacttctcagcctcagcacctaaccctcacacaacactccagta

SEQ ID NO: 6250 - DNA, 50 bp, Homo sapiens
tgagtattgttgtgggggcgggtatgtctgtatataaatctgtgcagcca

SEQ ID NO: 6251 - DNA, 50 bp, Homo sapiens; identical to SEQ ID NO: 4263

SEQ ID NO: 6252 - DNA, 50 bp, Homo sapiens; identical to SEQ ID NO: 4347

SEQ ID NO: 6253 - DNA, 50 bp, Homo sapiens; identical to SEQ ID NO: 4226

SEQ ID NO: 6254 - DNA, 50 bp, Homo sapiens; identical to SEQ ID NO: 4353

SEQ ID NO: 6255 - DNA, 50 bp, Homo sapiens
aggttgttatcaggtggcacaaattaaatccatcttgaagacttcacaca

SEQ ID NO: 6256 - DNA, 50 bp, Homo sapiens; identical to SEQ ID NO: 5073

SEQ ID NO: 6257 - DNA, 50 bp, Homo sapiens
agagctatgggtgctacaggcttgtctttctaagtgacatattcttatct

SEQ ID NO: 6258 - DNA, 50 bp, Homo sapiens
acccttataaaccagagcccaggaaagacagctcgagtgtataattctct

SEQ ID NO: 6259 - DNA, 50 bp, Homo sapiens
agctcctccctctcaacacccagtttccttgggagttgtcattaaaggaa

SEQ ID NO: 6260 - DNA, 50 bp, Homo sapiens
gctgtaattctctgtctcatcatccttctcttttgtttccatagcctttt

SEQ ID NO: 6261 - DNA, 50 bp, Homo sapiens; identical to SEQ ID NO: 4227

SEQ ID NO: 6262 - DNA, 50 bp, Homo sapiens; identical to SEQ ID NO: 4306

SEQ ID NO: 6263 - DNA, 50 bp, Homo sapiens; identical to SEQ ID NO: 4322

SEQ ID NO: 6264 - DNA, 50 bp, Homo sapiens; identical to SEQ ID NO: 4208

SEQ ID NO: 6265 - DNA, 50 bp, Homo sapiens
agaggcaacacttaaacactagggctactgtggcatctatgtagacagga

SEQ ID NO: 6266 - DNA, 50 bp, Homo sapiens; identical to SEQ ID NO: 4296

SEQ ID NO: 6267 - DNA, 50 bp, Homo sapiens; identical to SEQ ID NO: 4274

SEQ ID NO: 6268 - DNA, 50 bp, Homo sapiens; identical to SEQ ID NO: 4273

SEQ ID NO: 6269 - DNA, 50 bp, Homo sapiens; identical to SEQ ID NO: 4250

SEQ ID NO: 6270 - DNA, 50 bp, Homo sapiens; identical to SEQ ID NO: 238

SEQ ID NO: 6271 - DNA, 50 bp, Homo sapiens; identical to SEQ ID NO: 4305

SEQ ID NO: 6272 - DNA, 50 bp, Homo sapiens
acttcccctttaggtatccctggagtaataatgacaacaaaattcactgc

SEQ ID NO: 6273 - DNA, 50 bp, Homo sapiens; identical to SEQ ID NO: 4205

SEQ ID NO: 6274 - DNA, 50 bp, Homo sapiens; identical to SEQ ID NO: 5148

SEQ ID NO: 6275 - DNA, 50 bp, Homo sapiens; identical to SEQ ID NO: 5170

SEQ ID NO: 6276 - DNA, 50 bp, Homo sapiens; identical to SEQ ID NO: 5189

SEQ ID NO: 6277 - DNA, 50 bp, Homo sapiens; identical to SEQ ID NO: 5215

SEQ ID NO: 6278 - DNA, 50 bp, Homo sapiens; identical to SEQ ID NO: 5262

SEQ ID NO: 6279 - DNA, 50 bp, Homo sapiens; identical to SEQ ID NO: 5269

SEQ ID NO: 6280 - DNA, 50 bp, Homo sapiens; identical to SEQ ID NO: 5328

SEQ ID NO: 6281 - DNA, 50 bp, Homo sapiens; identical to SEQ ID NO: 5341

SEQ ID NO: 6282 - DNA, 51 bp, Homo sapiens
gcaactgttttctaggacatgtttactagaactactttaagtatgctgtgc

SEQ ID NO: 6283 - DNA, 50 bp, Homo sapiens; identical to SEQ ID NO: 5350

SEQ ID NO: 6284 - DNA, 50 bp, Homo sapiens; identical to SEQ ID NO: 5357

SEQ ID NO: 6285 - DNA, 50 bp, Homo sapiens; identical to SEQ ID NO: 5359

SEQ ID NO: 6286 - DNA, 50 bp, Homo sapiens; identical to SEQ ID NO: 5363

SEQ ID NO: 6287 - DNA, 50 bp, Homo sapiens; identical to SEQ ID NO: 5366

SEQ ID NO: 6288 - DNA, 50 bp, Homo sapiens; identical to SEQ ID NO: 5368

SEQ ID NO: 6289 - DNA, 50 bp, Homo sapiens; identical to SEQ ID NO: 5379

SEQ ID NO: 6290 - DNA, 50 bp, Homo sapiens; identical to SEQ ID NO: 5388

SEQ ID NO: 6291 - DNA, 50 bp, Homo sapiens; identical to SEQ ID NO: 5422

SEQ ID NO: 6292 - DNA, 50 bp, Homo sapiens; identical to SEQ ID NO: 5446

SEQ ID NO: 6293 - DNA, 50 bp, Homo sapiens; identical to SEQ ID NO: 5447

SEQ ID NO: 6294 - DNA, 50 bp, Homo sapiens; identical to SEQ ID NO: 5454

SEQ ID NO: 6295 - DNA, 50 bp, Homo sapiens; identical to SEQ ID NO: 5494

SEQ ID NO: 6296 - DNA, 50 bp, Homo sapiens; identical to SEQ ID NO: 5496

SEQ ID NO: 6297 - DNA, 50 bp, Homo sapiens; identical to SEQ ID NO: 5501

SEQ ID NO: 6298 - DNA, 50 bp, Homo sapiens; identical to SEQ ID NO: 5508

SEQ ID NO: 6299 - DNA, 50 bp, Homo sapiens; identical to SEQ ID NO: 5517

SEQ ID NO: 6300 - DNA, 50 bp, Homo sapiens; identical to SEQ ID NO: 5519

SEQ ID NO: 6301 - DNA, 50 bp, Homo sapiens; identical to SEQ ID NO: 5522

SEQ ID NO: 6302 - DNA, 50 bp, Homo sapiens; identical to SEQ ID NO: 5525

SEQ ID NO: 6303 - DNA, 50 bp, Homo sapiens; identical to SEQ ID NO: 5527

SEQ ID NO: 6304 - DNA, 50 bp, Homo sapiens; identical to SEQ ID NO: 5540

SEQ ID NO: 6305 - DNA, 50 bp, Homo sapiens; identical to SEQ ID NO: 5542

SEQ ID NO: 6306 - DNA, 50 bp, Homo sapiens; identical to SEQ ID NO: 5543

SEQ ID NO: 6307 - DNA, 50 bp, Homo sapiens; identical to SEQ ID NO: 5552

SEQ ID NO: 6308 - DNA, 50 bp, Homo sapiens; identical to SEQ ID NO: 5559

SEQ ID NO: 6309 - DNA, 50 bp, Homo sapiens; identical to SEQ ID NO: 5571

SEQ ID NO: 6310 - DNA, 50 bp, Homo sapiens; identical to SEQ ID NO: 5682

SEQ ID NO: 6311 - DNA, 50 bp, Homo sapiens; identical to SEQ ID NO: 5712

SEQ ID NO: 6312 - DNA, 50 bp, Homo sapiens; identical to SEQ ID NO: 5714

SEQ ID NO: 6313 - DNA, 50 bp, Homo sapiens; identical to SEQ ID NO: 5723

SEQ ID NO: 6314 - DNA, 50 bp, Homo sapiens; identical to SEQ ID NO: 5725

SEQ ID NO: 6315 - DNA, 50 bp, Homo sapiens; identical to SEQ ID NO: 5775

SEQ ID NO: 6316 - DNA, 50 bp, Homo sapiens; identical to SEQ ID NO: 5938

SEQ ID NO: 6317 - DNA, 50 bp, Homo sapiens; identical to SEQ ID NO: 5944

SEQ ID NO: 6318 - DNA, 50 bp, Homo sapiens; identical to SEQ ID NO: 5953

SEQ ID NO: 6319 - DNA, 50 bp, Homo sapiens; identical to SEQ ID NO: 5954

SEQ ID NO: 6320 - DNA, 50 bp, Homo sapiens; identical to SEQ ID NO: 5959

SEQ ID NO: 6321 - DNA, 50 bp, Homo sapiens; identical to SEQ ID NO: 5961

SEQ ID NO: 6322 - DNA, 50 bp, Homo sapiens; identical to SEQ ID NO: 6002

SEQ ID NO: 6323 - DNA, 50 bp, Homo sapiens; identical to SEQ ID NO: 6010

SEQ ID NO: 6324 - DNA, 50 bp, Homo sapiens
tggcataatgttggattgaatctacattttggcagaagttaaacattccc

SEQ ID NO: 6325 - DNA, 50 bp, Homo sapiens; identical to SEQ ID NO: 6014

SEQ ID NO: 6326 - DNA, 50 bp, Homo sapiens; identical to SEQ ID NO: 6019

SEQ ID NO: 6327 - DNA, 50 bp, Homo sapiens; identical to SEQ ID NO: 6023

SEQ ID NO: 6328 - DNA, 50 bp, Homo sapiens; identical to SEQ ID NO: 6027

SEQ ID NO: 6329 - DNA, 50 bp, Homo sapiens; identical to SEQ ID NO: 6031

SEQ ID NO: 6330 - DNA, 50 bp, Homo sapiens; identical to SEQ ID NO: 6032

SEQ ID NO: 6331 - DNA, 50 bp, Homo sapiens; identical to SEQ ID NO: 4348

SEQ ID NO: 6332 - DNA, 50 bp, Homo sapiens; identical to SEQ ID NO: 6037

SEQ ID NO: 6333 - DNA, 50 bp, Homo sapiens; identical to SEQ ID NO: 6039

SEQ ID NO: 6334 - DNA, 50 bp, Homo sapiens; identical to SEQ ID NO: 6041

SEQ ID NO: 6335 - DNA, 50 bp, Homo sapiens; identical to SEQ ID NO: 6042

SEQ ID NO: 6336 - DNA, 50 bp, Homo sapiens; identical to SEQ ID NO: 6044

SEQ ID NO: 6337 - DNA, 50 bp, Homo sapiens; identical to SEQ ID NO: 6047

SEQ ID NO: 6338 - DNA, 50 bp, Homo sapiens; identical to SEQ ID NO: 6051

SEQ ID NO: 6339 - DNA, 50 bp, Homo sapiens; identical to SEQ ID NO: 6065

SEQ ID NO: 6340 - DNA, 50 bp, Homo sapiens; identical to SEQ ID NO: 6088

SEQ ID NO: 6341 - DNA, 50 bp, Homo sapiens; identical to SEQ ID NO: 6124

SEQ ID NO: 6342 - DNA, 50 bp, Homo sapiens; identical to SEQ ID NO: 6126

SEQ ID NO: 6343 - DNA, 50 bp, Homo sapiens; identical to SEQ ID NO: 6129

SEQ ID NO: 6344 - DNA, 50 bp, Homo sapiens; identical to SEQ ID NO: 6130

SEQ ID NO: 6345 - DNA, 50 bp, Homo sapiens
gctggagggagaggcactggggaatttttcctggtgaatactgaagttac

SEQ ID NO: 6346 - DNA, 50 bp, Homo sapiens; identical to SEQ ID NO: 6139

SEQ ID NO: 6347 - DNA, 50 bp, Homo sapiens
actgccagtgaagactgtaaagacagaacacactattttggagggaggat

SEQ ID NO: 6348 - DNA, 50 bp, Homo sapiens; identical to SEQ ID NO: 6142

SEQ ID NO: 6349 - DNA, 50 bp, Homo sapiens; identical to SEQ ID NO: 6143

SEQ ID NO: 6350 - DNA, 50 bp, Homo sapiens; identical to SEQ ID NO: 6144

SEQ ID NO: 6351 - DNA, 50 bp, Homo sapiens; identical to SEQ ID NO: 6149

SEQ ID NO: 6352 - DNA, 50 bp, Homo sapiens; identical to SEQ ID NO: 6154

SEQ ID NO: 6353 - DNA, 50 bp, Homo sapiens; identical to SEQ ID NO: 6156

SEQ ID NO: 6354 - DNA, 50 bp, Homo sapiens; identical to SEQ ID NO: 6158

SEQ ID NO: 6355 - DNA, 50 bp, Homo sapiens; identical to SEQ ID NO: 6159

SEQ ID NO: 6356 - DNA, 50 bp, Homo sapiens; identical to SEQ ID NO: 6169

SEQ ID NO: 6357 - DNA, 50 bp, Homo sapiens; identical to SEQ ID NO: 6171

SEQ ID NO: 6358 - DNA, 50 bp, Homo sapiens; identical to SEQ ID NO: 6173

SEQ ID NO: 6359 - DNA, 50 bp, Homo sapiens; identical to SEQ ID NO: 5309

SEQ ID NO: 6360 - DNA, 50 bp, Homo sapiens
aaggcaaccaaccacattagaagtcttggcactttgtaacggaacgggta

SEQ ID NO: 6361 - DNA, 50 bp, Homo sapiens; identical to SEQ ID NO: 6177

SEQ ID NO: 6362 - DNA, 50 bp, Homo sapiens; identical to SEQ ID NO: 6179

SEQ ID NO: 6363 - DNA, 50 bp, Homo sapiens; identical to SEQ ID NO: 6180

SEQ ID NO: 6364 - DNA, 50 bp, Homo sapiens; identical to SEQ ID NO: 6181

SEQ ID NO: 6365 - DNA, 50 bp, Homo sapiens; identical to SEQ ID NO: 6183

SEQ ID NO: 6366 - DNA, 50 bp, Homo sapiens; identical to SEQ ID NO: 6187

SEQ ID NO: 6367 - DNA, 50 bp, Homo sapiens; identical to SEQ ID NO: 6188

SEQ ID NO: 6368 - DNA, 50 bp, Homo sapiens; identical to SEQ ID NO: 6189

SEQ ID NO: 6369 - DNA, 50 bp, Homo sapiens; identical to SEQ ID NO: 6193

SEQ ID NO: 6370 - DNA, 50 bp, Homo sapiens; identical to SEQ ID NO: 6141

SEQ ID NO: 6371 - DNA, 50 bp, Homo sapiens; identical to SEQ ID NO: 1043

SEQ ID NO: 6372 - DNA, 50 bp, Homo sapiens
gtggaaatcagcacacaaccacaatgacatttaagcacaggatcattatt

SEQ ID NO: 6373 - DNA, 50 bp, Homo sapiens
agaatggcagacctgtttgctgaagtgttcataagataacaataggcttg

SEQ ID NO: 6374 - DNA, 50 bp, Homo sapiens
tgggattttgtttttaagtcatttggtttggggaggaccttgtttatttt

SEQ ID NO: 6375 - DNA, 50 bp, Homo sapiens
tggacaaactgacagggactgctttgaaagacaggtactcagttgagtat

SEQ ID NO: 6376 - DNA, 50 bp, Homo sapiens; identical to SEQ ID NO: 6225

SEQ ID NO: 6377 - DNA, 50 bp, Homo sapiens; identical to SEQ ID NO: 6233

SEQ ID NO: 6378 - DNA, 50 bp, Homo sapiens; identical to SEQ ID NO: 6236

SEQ ID NO: 6379 - DNA, 50 bp, Homo sapiens
agcagagttaagtttaaatttccattctcactagtttgtgacctttgcca

SEQ ID NO: 6380 - DNA, 50 bp, Homo sapiens; identical to SEQ ID NO: 6250

SEQ ID NO: 6381 - DNA, 50 bp, Homo sapiens
cccttgcagatacatgagacaggcaggggctggagtcttgttccatcctg

SEQ ID NO: 6382 - DNA, 50 bp, Homo sapiens
gagtagttgtctttcctggcactaacgttgagctcgtgtacgcactgaag

SEQ ID NO: 6383 - DNA, 50 bp, Homo sapiens
gagtccaatctacactctagtagtgaagacagaagagttggcatacgagt

SEQ ID NO: 6384 - DNA, 50 bp, Homo sapiens
ggctgaacttactcattaagccacataacttcgagtcaagttccagtcca

SEQ ID NO: 6385 - DNA, 50 bp, Homo sapiens
gctctcaagcctcctccaataaagctctatcgggaaacaaatgaaccagt

SEQ ID NO: 6386 - DNA, 50 bp, Homo sapiens
aggaatgcacacattgctccaggatcactgtgaggattaaaggagatggt

SEQ ID NO: 6387 - DNA, 50 bp, Homo sapiens
agtaacggaacagttcccagtactcctggttcctaggtgagcaggtgatg

SEQ ID NO: 6388 - DNA, 50 bp, Homo sapiens
ggtgtgaaccatgagaagttcgacaacagcctcaagatcatcagcaatga

SEQ ID NO: 6389 - DNA, 50 bp, Homo sapiens
ggaggtgtataggctgggatttgaaaaggaaaataatcagcgtggtgcca

SEQ ID NO: 6390 - DNA, 50 bp, Homo sapiens; identical to SEQ ID NO: 326

SEQ ID NO: 6391 - DNA, 50 bp, Homo sapiens
tccagcagatataggaagcagtgtatctaaacagacaaataaaaaggcct

SEQ ID NO: 6392 - DNA, 50 bp, Homo sapiens
atctagtgtacgagacttggagtcaggcagtgagactggtggggcacggg

SEQ ID NO: 6393 - DNA, 50 bp, Homo sapiens
tggtttaatggaaaatgctctggaaaattcttttgcaacagttcatcgct

SEQ ID NO: 6394 - DNA, 50 bp, Homo sapiens
cactaaaagagtggggaggtgcagcacctggctggggaacaagaatatgg

SEQ ID NO: 6395 - DNA, 50 bp, Homo sapiens
aaacgaatcacgtgcctcgaaagggacatatattgttcctttaagcattt

SEQ ID NO: 6396 - DNA, 50 bp, Homo sapiens
aagggttcaatttcttctttggaaggtgatggtaagggtgtggctccaga

SEQ ID NO: 6397 - DNA, 50 bp, Homo sapiens
tggacaattccaagtccaagaggactgtctactttcgaccttgtgtgatt

SEQ ID NO: 6398 - DNA, 50 bp, Homo sapiens
ttgtgttaacctgttgtccacgctaagatacaaacttcccggaggaaagt

SEQ ID NO: 6399 - DNA, 50 bp, Homo sapiens
tgtcacagtgttctattatttgcccggttcttaaagtgagagcatcctga

SEQ ID NO: 6400 - DNA, 50 bp, Homo sapiens
acaatgatattgatgaggcacccagtcttttcatttactctgagtgaagt

SEQ ID NO: 6401 - DNA, 50 bp, Homo sapiens; identical to SEQ ID NO: 3230

SEQ ID NO: 6402 - DNA, 50 bp, Homo sapiens
ggccagagaccctaagctgcttaatacatttataccacatccttctcagc

SEQ ID NO: 6403 - DNA, 50 bp, Homo sapiens
cccttggaattacttgttcaacttctttctttcccactagacggggactt

SEQ ID NO: 6404 - DNA, 50 bp, Homo sapiens
ctttgtagatgcagagagaagctataagaaaccccagtacttgccgggcg

SEQ ID NO: 6405 - DNA, 54 bp, Homo sapiens
actgccacatctgactttacagaataaccaatgtaagttaaaatagagaaacag

SEQ ID NO: 6406 - DNA, 50 bp, Homo sapiens
agtcttgcgagtcaactcagactcaaatgtagaactgggaaggacagtgc

SEQ ID NO: 6407 - DNA, 50 bp, Homo sapiens
agcactgtgcagatggctttagaagattcagaacagaagcacaatctgtt

SEQ ID NO: 6408 - DNA, 50 bp, Homo sapiens
agcactgtgcagatggctttggaagattcagaacagaagcacaatctgtt

SEQ ID NO: 6409 - DNA, 50 bp, Homo sapiens
ctatggagtcttggaggacactggagtcaccatgctaacactgtgcagat

SEQ ID NO: 6410 - DNA, 50 bp, Homo sapiens
ccctgtcacccttcgtggccagtgccagacagtaactagtggatgctaaa

SEQ ID NO: 6411 - DNA, 50 bp, Homo sapiens
gagagaatagggtagagagaccgggacttgggtagagatgaccgggattc

SEQ ID NO: 6412 - DNA, 50 bp, Homo sapiens
agtggaagctaggagaaatatcgaatgtgttagggactttgaagttacca

SEQ ID NO: 6413 - DNA, 50 bp, Homo sapiens
ctgcatctctctttactaccagtgattacaaagtggggtttggtgggagt

SEQ ID NO: 6414 - DNA, 50 bp, Homo sapiens
tctctgacttcttattaccaaggacactctatctgttgcctcttactctt

SEQ ID NO: 6415 - DNA, 50 bp, Homo sapiens
cagttcccagatgtgcgtgttgtggtccccaagtatcaccttccaatttc

SEQ ID NO: 6416 - DNA, 50 bp, Homo sapiens
aacgaccctgtattgcagaagattgtagacattctgtatgccacagatga

SEQ ID NO: 6417 - DNA, 50 bp, Homo sapiens
gggtcccgagcccttcaagagctagatttactcaagtttgttcccttgcc

SEQ ID NO: 6418 - DNA, 50 bp, Homo sapiens
cactgaagccaaaccacagaagacttttgagaatgaggagacaaatgagt

SEQ ID NO: 6419 - DNA, 50 bp, Homo sapiens
aggtgaaaattactcttcagaagatagcagagtggataatggcccatcga

SEQ ID NO: 6420 - DNA, 50 bp, Homo sapiens
tgcagtgagactacatttctgtctaaagaagatgtgtgagttccgtcctt

SEQ ID NO: 6421 - DNA, 50 bp, Homo sapiens
tccagccagccagctcatttcactttacaccctcatggactgggattata

SEQ ID NO: 6422 - DNA, 50 bp, Homo sapiens
tttcatacattggaactccacctgactttggaccaaccccagaacagagc

SEQ ID NO: 6423 - DNA, 50 bp, Homo sapiens
agcaccggaatacaaaaatgatactatgctgccctcctagatctcaggga

SEQ ID NO: 6424 - DNA, 50 bp, Homo sapiens
tgcccatacacatgagtatttgtctaaaacatgtcttctttgtagcagct

SEQ ID NO: 6425 - DNA, 50 bp, Homo sapiens
gcaaatctaaactgcaggaaaatttttgcacccgaagtattcagatccct

SEQ ID NO: 6426 - DNA, 50 bp, Homo sapiens
ggcccagtgctaatgtaaccaatgatgccatgtcgatattggaaaccata

SEQ ID NO: 6427 - DNA, 50 bp, Homo sapiens
ggggaagaacaagataatctagtgacctcaccacagtctatgcccaggcc

SEQ ID NO: 6428 - DNA, 50 bp, Homo sapiens
aattcaactgaaggcgaggaatgttggtgatgaagctgagatcaggactc

SEQ ID NO: 6429 - DNA, 50 bp, Homo sapiens
cacctatatcgaaagtttgggctcatctcccattggtggcaaagacctcc

SEQ ID NO: 6430 - DNA, 50 bp, Homo sapiens
tggtggaaaagtgtgtctgtctgacaattacactcaagtttacctctggt

SEQ ID NO: 6431 - DNA, 53 bp, Homo sapiens
acgataatactgttggttactgccataaatattggaagctaatgtaaaatgca

SEQ ID NO: 6432 - DNA, 50 bp, Homo sapiens
ttctcttataaaggacagcaagtttaaaatggagcaaggagcattggaaa

SEQ ID NO: 6433 - DNA, 50 bp, Homo sapiens
tggccaaagaatagaagctctagaccttccttatttctatcgtgaaaaca

SEQ ID NO: 6434 - DNA, 50 bp, Homo sapiens
acatgacctgtgcagtgtgtggctgtgaattctgttggctttgtatgaaa

SEQ ID NO: 6435 - DNA, 50 bp, Homo sapiens
tgacataactaccatccctgcaactaatgaacccaccctcacagcttcct

SEQ ID NO: 6436 - DNA, 50 bp, Homo sapiens
gaatgacataaaccccctccggtctgaggtccggccttccagcttgtctc

SEQ ID NO: 6437 - DNA, 50 bp, Homo sapiens
gcctttctcactccatccccacccaaagtgctcagaccttgtctagttat

SEQ ID NO: 6438 - DNA, 50 bp, Homo sapiens
tcgttttacaacgtcgtgactgggaaaaccctggcgttacccaacttaat

SEQ ID NO: 6439 - DNA, 50 bp, Homo sapiens
tgttttgttttctgaaacgaaatcctgctctgttggcccagctagaacgc

SEQ ID NO: 6440 - DNA, 50 bp, Homo sapiens
cagaagctggatgacgttgctccatcttcactctgttaatgagacatgat

SEQ ID NO: 6441 - DNA, 50 bp, Homo sapiens
cacatcttccattcagccctaccatgaaaaccgtacctcgggcgcgacca

SEQ ID NO: 6442 - DNA, 50 bp, Homo sapiens
aatttgctttaaattgagtttccttgccattgcacactcctatctttctg

SEQ ID NO: 6443 - DNA, 50 bp, Homo sapiens
cagatgacacgcgctctccaccacccaacccaaaccatgagaatttgcaa

SEQ ID NO: 6444 - DNA, 50 bp, Homo sapiens
cccatgctgttgattgctaaatgtaacagtctgatcgtgacgctgaataa

SEQ ID NO: 6445 - DNA, 50 bp, Homo sapiens
gacacagacagaccaagctatagtcagacctggttacacacatacacaca

SEQ ID NO: 6446 - DNA, 50 bp, Homo sapiens
tggcaaagatcactgaaatttaggacaccaaagctaaaaccccaaatgct

SEQ ID NO: 6447 - DNA, 50 bp, Homo sapiens
gcttgtgctcgagaccgcttgctatagaaacgctgagctgctggtttatg

SEQ ID NO: 6448 - DNA, 50 bp, Homo sapiens
ctggttaaaagccccattactgaccttcgccgccaccacgcctatcacta

SEQ ID NO: 6449 - DNA, 50 bp, Homo sapiens
gcatccacctccttctctgtctcatgtgtgctcttcttctttctacagta

SEQ ID NO: 6450 - DNA, 50 bp, Homo sapiens
ttaaatctatcaagaattcatccaaattggtaccctgccgggccgcctcg

SEQ ID NO: 6451 - DNA, 50 bp, Homo sapiens
agtgctgtattgactttgctcggcagtagatgaagctattctgaacccaa

SEQ ID NO: 6452 - DNA, 50 bp, Homo sapiens
tgctggacaaagacaatgagatgattattggtggtgggatggctgttacc

SEQ ID NO: 6453 - DNA, 50 bp, Homo sapiens
gtggaaaagtcactaccaggctggcagggaatggggcaatctattcatac

SEQ ID NO: 6454 - DNA, 50 bp, Homo sapiens
aagggacagggagcgggcacaaaataaaacttagtttggtagaaattata

SEQ ID NO: 6455 - DNA, 50 bp, Homo sapiens
tcaaagcactggagatgagagccaggatggacccgaaaagaattttacag

SEQ ID NO: 6456 - DNA, 56 bp, Homo sapiens
caggaacatggctgcagcatataaaaagaattgaattccatacttttgttaaccct

SEQ ID NO: 6457 - DNA, 50 bp, Homo sapiens
ttgccataaccacgcttgtagattagttcatttactgacttcagattggg

SEQ ID NO: 6458 - DNA, 50 bp, Homo sapiens
ttacaggcaaccggagcatccaatcacctttctctaagagagtacctcgg

SEQ ID NO: 6459 - DNA, 50 bp, Homo sapiens
aaaagcatcttcgagagggactgtcaattctcgactattttccaacccgc

SEQ ID NO: 6460 - DNA, 50 bp, Homo sapiens; identical to SEQ ID NO: 2020

SEQ ID NO: 6461 - DNA, 50 bp, Homo sapiens
agagacacctaaattacagatttgtgagctgagagctggagtttttcatt

SEQ ID NO: 6462 - DNA, 50 bp, Homo sapiens
aacagcaaagagagttacgaattacgttacttccagattaaccaggacga

SEQ ID NO: 6463 - DNA, 50 bp, Homo sapiens
agcgcaagatagatttggaataggaataagctctagttcttaacaaccga

SEQ ID NO: 6464 - DNA, 50 bp, Homo sapiens
gcatggacaagatgccaaggcccggatgctttaggatgaagttcttatct

SEQ ID NO: 6465 - DNA, 50 bp, Homo sapiens
cctccagtcaccatacacaggttaccagtgtcgaacttgatgaaatcagt

SEQ ID NO: 6466 - DNA, 50 bp, Homo sapiens
ccaaacatctggacttgtgactgtaaaaggggaggaggtagccaatgatt

SEQ ID NO: 6467 - DNA, 50 bp, Homo sapiens
ttatggtggtcggggtgggtggtagttcaatgggaggtatgggatttatt

SEQ ID NO: 6468 - DNA, 50 bp, Homo sapiens
agctgtctggctcaaagatctacattctgaagttggctggaaatgtcttg

SEQ ID NO: 6469 - DNA, 50 bp, Homo sapiens
ctggttcctaccagtgccagtgccttcagggcttcacaggccagtacctc

SEQ ID NO: 6470 - DNA, 50 bp, Homo sapiens
tgacacagactgtttcaatcttggagcagcgactgactttgacagaagat

SEQ ID NO: 6471 - DNA, 50 bp, Homo sapiens
tgctatttaaagcaccatgataaatatgaggccacttggaaatccatcca

SEQ ID NO: 6472 - DNA, 50 bp, Homo sapiens
gcaggcgatgctctataatctaaaatgtatctctctttccctaagctgaa

SEQ ID NO: 6473 - DNA, 50 bp, Homo sapiens
aagtaagaccacctgtgaacttgatcattatctggcgcacataggaagat

SEQ ID NO: 6474 - DNA, 50 bp, Homo sapiens
gctggggctgggaattgcgtgggctaatgtgtcatttgacttaagaaact

SEQ ID NO: 6475 - DNA, 50 bp, Homo sapiens
tttgggaagaaccgattgctaaattatgcctaattcatgtcagaagaggg

SEQ ID NO: 6476 - DNA, 50 bp, Homo sapiens
aagcagtataccatttatatagcaaacagccagtggccagttcactgtat

SEQ ID NO: 6477 - DNA, 50 bp, Homo sapiens
ctgccctttggtagtgagaggaccacgccaatgatgcttttaagtaacct

SEQ ID NO: 6478 - DNA, 50 bp, Homo sapiens
catttcttcatctctaaggcacacttgctacccctctttgctgaccccag

SEQ ID NO: 6479 - DNA, 50 bp, Homo sapiens
gcctgcgtgtctgtctcagtgtttcctggtcctcctctaagtactctaaa

SEQ ID NO: 6480 - DNA, 50 bp, Homo sapiens
aatcctagacatgtgcttgtcattgctcccatgaaggtagttttcaaaca

SEQ ID NO: 6481 - DNA, 50 bp, Homo sapiens
accaatagagaagaagctctagaagacaaaatcccaaaccttggcacaaa

SEQ ID NO: 6482 - DNA, 50 bp, Homo sapiens
ggcttcaacagaaacatcaaatgccaagaccagtgagagagcgtcaaaaa

SEQ ID NO: 6483 - DNA, 50 bp, Homo sapiens
gcaagcccactaaaataaacatctaaccagcatctttcccccattatagg

SEQ ID NO: 6484 - DNA, 50 bp, Homo sapiens
atggatctgttcctctgtgctaaatgtcttgtggcagggtgtgtttgtgg

SEQ ID NO: 6485 - DNA, 50 bp, Homo sapiens
gccgtaatgtctcgggatctctaataatagaggaggtgagttgtggtgtc

SEQ ID NO: 6486 - DNA, 50 bp, Homo sapiens
aggcactcctcaaccagtgttcactgaattcaactgctgaaattgtaaca

SEQ ID NO: 6487 - DNA, 50 bp, Homo sapiens
agagagggttttaagggagggcttgtgaatacttgggagaatacggaagg

SEQ ID NO: 6488 - DNA, 50 bp, Homo sapiens
atgaatttgaagacatggtggctgaaaagcggctcatcccagatggctgt

SEQ ID NO: 6489 - DNA, 50 bp, Homo sapiens
ttccacagataggtaagccaggcgcggcaagatgagactgtattcagtta

SEQ ID NO: 6490 - DNA, 50 bp, Homo sapiens
tcttgtcctagtcattgtggcaaccccatctgacaccttgtgtagtacct

SEQ ID NO: 6491 - DNA, 50 bp, Homo sapiens; identical to SEQ ID NO: 362

SEQ ID NO: 6492 - DNA, 50 bp, Homo sapiens
tttcaacatggctagatccatcagaaactgaaggcggggagaaagctctc

SEQ ID NO: 6493 - DNA, 50 bp, Homo sapiens
ggtactcaaaggaaattactctttctctggaaccctggcagaaagtttta

SEQ ID NO: 6494 - DNA, 50 bp, Homo sapiens
atccttcctaccttttattatgaaagttttggtacctggcccggcgagcg

SEQ ID NO: 6495 - DNA, 50 bp, Homo sapiens
attaaggtttttaacatctactttgggtgatggagccttcaatgaagtca

SEQ ID NO: 6496 - DNA, 50 bp, Homo sapiens
gaaagactacgaatttcgctgggaggtaatagggaagccttccacataaa

SEQ ID NO: 6497 - DNA, 50 bp, Homo sapiens
aaatgaggtcagcaataaccttgattcggtcctccactggcaacatttta

SEQ ID NO: 6498 - DNA, 50 bp, Homo sapiens
cttctctccctgtaaccaggcagtgtgtgggcggggctcagaacatatct

SEQ ID NO: 6499 - DNA, 50 bp, Homo sapiens
gttgccctgatctggaaatcctgttgcttcttctgggatgaaggaacctc

SEQ ID NO: 6500 - DNA, 50 bp, Homo sapiens
taagataacccacaggcacttcctgtcataaagccaacgacacagaccag

SEQ ID NO: 6501 - DNA, 50 bp, Homo sapiens
atgggaacaggatgttaaatacacacatacatacgcacacaagcgttggg

SEQ ID NO: 6502 - DNA, 50 bp, Homo sapiens
cctctgctatcactagagaatgtagagaatggaaatggctgcctttatgc

SEQ ID NO: 6503 - DNA, 50 bp, Homo sapiens
gatacagatgtgattattcagcctcaaggggacttctccattgcgtaacg

SEQ ID NO: 6504 - DNA, 50 bp, Homo sapiens
ttattgttaccaattagaatcagcaattcaactgtgcggtgatttggcct

SEQ ID NO: 6505 - DNA, 50 bp, Homo sapiens
tcatcacttgggttaactaaaggtttgcgtatcacacaattacactacaa

SEQ ID NO: 6506 - DNA, 50 bp, Homo sapiens
ttcatagtcaaacaaaaggtaagatcatgcatatacccacggcaacaagg

SEQ ID NO: 6507 - DNA, 50 bp, Homo sapiens
cccacccccttcccctccatgtgaagatttgggtgcttaacatatcattt

SEQ ID NO: 6508 - DNA, 50 bp, Homo sapiens
gggagacatgctgattccactcaaagatctcataataaacagctttggcc

SEQ ID NO: 6509 - DNA, 50 bp, Homo sapiens
aaataaatttggaatgggacattgtgctgtttcaccttcaatgctgttaa

SEQ ID NO: 6510 - DNA, 50 bp, Homo sapiens
agaacagtcttgggttcaggggtgtgatgccagaatgtattttcgtacct

SEQ ID NO: 6511 - DNA, 50 bp, Homo sapiens
aaggcgaagtcaatcccatctccctgaacccaactgccagtaggtagttc

SEQ ID NO: 6512 - DNA, 50 bp, Homo sapiens
agttaaactgttggtgaggtagtgtgtcaggtactctgtatattagctct

SEQ ID NO: 6513 - DNA, 50 bp, Homo sapiens
actggataaacagaacggatcaaagataaaagtattcttgttgcctgggc

SEQ ID NO: 6514 - DNA, 50 bp, Homo sapiens
gtcccttaggggagggagagttgtcctctttgcccacagtctaccctcag

SEQ ID NO: 6515 - DNA, 50 bp, Homo sapiens
actggactactgaactttagaatactgtcctaaggaaataggtctgggca

SEQ ID NO: 6516 - DNA, 50 bp, Homo sapiens
caaacaacaaaagtggcctccatcgctgtgagcctctcaagggacagggc

SEQ ID NO: 6517 - DNA, 50 bp, Homo sapiens
aaggtggctggcttttatgatacagtggtggtaatgtagccctttttggt

SEQ ID NO: 6518 - DNA, 50 bp, Homo sapiens
tgctcaattgccatacatgcactataggccgggatagaaaatcgtcagct

SEQ ID NO: 6519 - DNA, 50 bp, Homo sapiens
ttcaaggatgtgactgatatctggtgtggtttattttgtttgttttgggg

SEQ ID NO: 6520 - DNA, 50 bp, Homo sapiens
agctttggaaatttgaacaaggtggggacaaaatcaggcaataacagact

SEQ ID NO: 6521 - DNA, 50 bp, Homo sapiens
cacttcctgagtgtttcctgagaacaaaggatcagagcttcggctgtgag

SEQ ID NO: 6522 - DNA, 50 bp, Homo sapiens
ttttccttttcgctgactttcccactcactgtctgtctctcattttctct

SEQ ID NO: 6523 - DNA, 50 bp, Homo sapiens
gcatgggaattggctgtcatcactcatagcacggtgtataaactcaagga

SEQ ID NO: 6524 - DNA, 50 bp, Homo sapiens
gtccactcaagttacctggctgtctatcttttggctgacccctgaagcga

SEQ ID NO: 6525 - DNA, 50 bp, Homo sapiens
ctaagtaagcaaagaggcagaggggaggaggggagtgtttggtactgtcc

SEQ ID NO: 6526 - DNA, 50 bp, Homo sapiens
tggtgcggtgttcatgattattatgcagggtggaagttcagtatttggtc

SEQ ID NO: 6527 - DNA, 50 bp, Homo sapiens
agcacatttgtgcagaaaggttttgcaggtatctgaggcactgctcacct

SEQ ID NO: 6528 - DNA, 50 bp, Homo sapiens
agaacaacacgggattgaagtgggaagagatgggaccctcattggatctg

SEQ ID NO: 6529 - DNA, 50 bp, Homo sapiens
ggaacaatagacctcttcactagctccctgctgtttgatggtttggttgg

SEQ ID NO: 6530 - DNA, 50 bp, Homo sapiens
agaggatgactttgaggtaaatgtttacgatgcacggttttaggcgatgt

SEQ ID NO: 6531 - DNA, 50 bp, Homo sapiens
gtgtcctggggagtgaggagaggtggagtagactctgagaggagtgaaaa

SEQ ID NO: 6532 - DNA, 50 bp, Homo sapiens
agatcatgtctggattgtgtttcctattacctagagacgaacacagatct

SEQ ID NO: 6533 - DNA, 50 bp, Homo sapiens
gtgtcccaggacgagcgggagtgcaccatggacctctccgagttcatgaa

SEQ ID NO: 6534 - DNA, 50 bp, Homo sapiens
tgtatggcttatagccagagatgaaacagaacccaagttaatattgccag

SEQ ID NO: 6535 - DNA, 50 bp, Homo sapiens
aggtttcagaatctgggccttacctttacaggttcaacaaaagaatggca

SEQ ID NO: 6536 - DNA, 50 bp, Homo sapiens
aagatgaggcgtagctcatgtacaaatgcagcattctcataagtgcttta

SEQ ID NO: 6537 - DNA, 50 bp, Homo sapiens
agatagtggtatttgggtgctgggcttgtctgaactgaggaggtgggtgc

SEQ ID NO: 6538 - DNA, 50 bp, Homo sapiens
ccttgcaccagagacgactgacatatatagatgggagtcactcatgcgct

SEQ ID NO: 6539 - DNA, 50 bp, Homo sapiens
ggtgtagcgtgaagatctggacagcgcactacgacccgggccactgtttc

SEQ ID NO: 6540 - DNA, 50 bp, Homo sapiens
agaagcaaacctgtgaagctactatcgtttatcatcagtgtgaatgcact

SEQ ID NO: 6541 - DNA, 50 bp, Homo sapiens
tagtgatacaatttggggtgccagaggttgggggtaaggaattttgaagc

SEQ ID NO: 6542 - DNA, 50 bp, Homo sapiens
gtgtggcctaaggaacacctcttgtggggagtaagagccagcccttcctc

SEQ ID NO: 6543 - DNA, 50 bp, Homo sapiens
agatgcgggcgcaagcttatgtcctgttatgagggtttaaattagattgg

SEQ ID NO: 6544 - DNA, 50 bp, Homo sapiens
tcataacgcccttcaaaacattgaataaaatcagtgcaaaacattgagca

SEQ ID NO: 6545 - DNA, 50 bp, Homo sapiens
tgagaaaggagttagcagaatattaacataccgagaagctgttgttagca

SEQ ID NO: 6546 - DNA, 50 bp, Homo sapiens
ctggagactcaggtcgcttaagtggaggggacgggcacagccattcctcc

SEQ ID NO: 6547 - DNA, 50 bp, Homo sapiens
aaagacctgccacttatttttggctctcatctgtactcttaagtgtgtgt

SEQ ID NO: 6548 - DNA, 50 bp, Homo sapiens
agacacagctgcagaaaacttattcttttcaagcatgcacagtcacaaaa

SEQ ID NO: 6549 - DNA, 50 bp, Homo sapiens
cattcaacaacacaaaccgagcacctactgtgtgccacgccacagacaag

SEQ ID NO: 6550 - DNA, 50 bp, Homo sapiens
cctaggaaacacaggtcaaagaaacacagtccaacatgtattcagaattc

SEQ ID NO: 6551 - DNA, 50 bp, Homo sapiens
aaacgcaatctattttaggtttgagattagaagctgaggccaaggactca

SEQ ID NO: 6552 - DNA, 50 bp, Homo sapiens
tcctccagatgcatggtccgtgaagaaatttaatagcaaagacgagaaga

SEQ ID NO: 6553 - DNA, 50 bp, Homo sapiens
ggctctcatgcttatgccacacatccttgattctgcttaggagtctctgg

SEQ ID NO: 6554 - DNA, 50 bp, Homo sapiens
aagcctgagctaacaagagctgaggacagtagcttattcctctttatggg

SEQ ID NO: 6555 - DNA, 50 bp, Homo sapiens
tggatgatgggattggataagcatgtggactggattgtgttacaaactct

SEQ ID NO: 6556 - DNA, 50 bp, Homo sapiens
tgctgtttctaggattaacacgaaatcatcactttgccatattttgagct

SEQ ID NO: 6557 - DNA, 50 bp, Homo sapiens
ggctcagcacaaaagagaattcgtagcactttcatgtgaaagcagaccca

SEQ ID NO: 6558 - DNA, 50 bp, Homo sapiens
gatattaaggtactttcagtacaaatctggtgctgtgagtgggctcatcc

SEQ ID NO: 6559 - DNA, 50 bp, Homo sapiens
tccagtttctcataaacaaattcttctatcctggcatttggatttgggtt

SEQ ID NO: 6560 - DNA, 50 bp, Homo sapiens
tcatggtcatagctgtaacctgtgtgaaatagtaatcagatcaaaaagcg

SEQ ID NO: 6561 - DNA, 50 bp, Homo sapiens
atatgtacctggagggcggacgatcgaaattactagtgaattagcggcag

SEQ ID NO: 6562 - DNA, 50 bp, Homo sapiens
tgcgagtgtaatttctgtaaggagggtatgggataattaatagcacgcct

SEQ ID NO: 6563 - DNA, 50 bp, Homo sapiens
gcccccagcattcaattcattttgtacccttagtttaaagaacttctccc

SEQ ID NO: 6564 - DNA, 50 bp, Homo sapiens
aactttgctttctgaaggttttggtgtacctcgggcgcgaacacgctaat

SEQ ID NO: 6565 - DNA, 50 bp, Homo sapiens
attgactccactttgtgccaagctctgcgggtaggcatatttcatatctt

SEQ ID NO: 6566 - DNA, 50 bp, Homo sapiens
cagtggagaagctgcactgtctccgggcttgtgtgatccgatctctgtac

SEQ ID NO: 6567 - DNA, 50 bp, Homo sapiens
agctttgaaagtaatgtctaaccctgctgtcagtttatcacaagtgcatt

SEQ ID NO: 6568 - DNA, 50 bp, Homo sapiens
agcttaattgaattggaggagcaccgaacaggcagtttcctgagcagtgg

SEQ ID NO: 6569 - DNA, 50 bp, Homo sapiens
gctctcactgatctctcttctctatctctttctgcagttataccagcact

SEQ ID NO: 6570 - DNA, 50 bp, Homo sapiens
tgagaagagctgtgaaggcagaggcggggcaagtgcaaaggtcctgactt

SEQ ID NO: 6571 - DNA, 50 bp, Homo sapiens
aactccctgttcagttcagttgctaatgatctcaagctcttccctgatta

SEQ ID NO: 6572 - DNA, 50 bp, Homo sapiens
cagcctaatgcctaaccacacagataccattggtgggcgacgtgacccag

SEQ ID NO: 6573 - DNA, 50 bp, Homo sapiens
caccatcttttgctcggatactagcccgcaatacccactcacctaccacc

SEQ ID NO: 6574 - DNA, 50 bp, Homo sapiens
agggtctccaccttacagaagtacatgaacaaccagagatagcagggctg

SEQ ID NO: 6575 - DNA, 50 bp, Homo sapiens
accaggaaaagtaaaaatcatagttggtgtctctcgggtttctcaccttc

SEQ ID NO: 6576 - DNA, 50 bp, Homo sapiens
atgtatgagagagattcgagatgagttaaaggagggaagggaggggtggt

SEQ ID NO: 6577 - DNA, 50 bp, Homo sapiens
catgagtattggcactggggttcaagttccagggcagagcaggataagag

SEQ ID NO: 6578 - DNA, 50 bp, Homo sapiens
ctcctggggctggagtcctggtctgccttctggggacagagattaggtcg

SEQ ID NO: 6579 - DNA, 50 bp, Homo sapiens
tggaacttcagtcaaaaacatctgtactttgtacaggacaaagatttggc

SEQ ID NO: 6580 - DNA, 50 bp, Homo sapiens
atagaacttgttttacctatgagccttgccttgtatttattcactgtggc

SEQ ID NO: 6581 - DNA, 50 bp, Homo sapiens
acatctcttgtgaaagttcaaatgttacagcaaggtgtaaacactccact

SEQ ID NO: 6582 - DNA, 50 bp, Homo sapiens
gggtgaattaatcgggagatgggtagtcagggcaaatgatgggtgggttt

SEQ ID NO: 6583 - DNA, 50 bp, Homo sapiens
tgcaattgtggagacaaattgttagagtttaaatcctggctctgttccct

SEQ ID NO: 6584 - DNA, 50 bp, Homo sapiens
ggacctatgtcctcaagacatggaaactactagttctgtcgtgccaggag

SEQ ID NO: 6585 - DNA, 50 bp, Homo sapiens
aattaaggatgccctaccgacatctatcagcatacctggaacaggttcga

SEQ ID NO: 6586 - DNA, 50 bp, Homo sapiens
cggccaacccaggagggcaggtgttttgggcatctggtttatagtacctc

SEQ ID NO: 6587 - DNA, 50 bp, Homo sapiens
gctggggtgaaaacttgaagactcagacctcagtggaaacagatgaatgt

SEQ ID NO: 6588 - DNA, 50 bp, Homo sapiens
ccccaggctctgtgacgcttgaaattctaattagcgcagaaaagggctaa

SEQ ID NO: 6589 - DNA, 50 bp, Homo sapiens
cctgactacgtgttttccccacagacatcacactggttcacctcgttgaa

SEQ ID NO: 6590 - DNA, 53 bp, Homo sapiens
aatggaaagacacttctgtatacactggaaatctcaggaaatttcttttttcc

SEQ ID NO: 6591 - DNA, 50 bp, Homo sapiens
gacagtacagtaccctaagagcactgaggagggccaccccacgtgaactc

SEQ ID NO: 6592 - DNA, 50 bp, Homo sapiens
tttccttggagatttcaggcatcttaggccggaagggacctcgaaggtgg

SEQ ID NO: 6593 - DNA, 50 bp, Homo sapiens
ctccgcttctttcactcattcgtttagtgtttctttaagctttgccttgt

SEQ ID NO: 6594 - DNA, 50 bp, Homo sapiens
tccacattttgatcatgcatttatgaaagccctgggtttgttattgagaa

SEQ ID NO: 6595 - DNA, 50 bp, Homo sapiens
gctatcttctgctgaatcagcgtaatgctgatatacaccctattttctgt

SEQ ID NO: 6596 - DNA, 50 bp, Homo sapiens
aaaagaaaagtttttcaacccagggaatttatagtgggtgtcagtcgaga

SEQ ID NO: 6597 - DNA, 50 bp, Homo sapiens
aggagacgatgtagggggaagtgtgttagattgtaatggaggggtttgga

SEQ ID NO: 6598 - DNA, 50 bp, Homo sapiens
gctctttcccagacccagccgccaggttctctgtagaagaaaataaatgc

SEQ ID NO: 6599 - DNA, 50 bp, Homo sapiens
aaggaggaatgggaatctcaagctcaagggcactctcactaattgtgggt

SEQ ID NO: 6600 - DNA, 50 bp, Homo sapiens
aaatagccaccttctccccattttctgtcagaacacacactttatatcca

SEQ ID NO: 6601 - DNA, 50 bp, Homo sapiens
tttggtaaaagagattggaggggacaccagggaaaccaggattttctggc

SEQ ID NO: 6602 - DNA, 50 bp, Homo sapiens
aagtgctaaggcattctctaaactatctttccagctccgggcgacaatgg

SEQ ID NO: 6603 - DNA, 50 bp, Homo sapiens
ccactctctaagtcaagcgagtccttcctgcatacctgtactgggtgctg

SEQ ID NO: 6604 - DNA, 50 bp, Homo sapiens
ggactttgcaggcttcattccctgtctgtgtcttttccttctggtgtgtt

SEQ ID NO: 6605 - DNA, 50 bp, Homo sapiens
atttgctggccaatcctgctgactatgaatctttgggggcactgagttac

SEQ ID NO: 6606 - DNA, 50 bp, Homo sapiens
ctggggtactggggaaaaggaactggtattgagattttatatttggggcg

SEQ ID NO: 6607 - DNA, 50 bp, Homo sapiens
ttgagtaaggctcagagttgcagatgaggtgcagagaacatcctgtgact

SEQ ID NO: 6608 - DNA, 50 bp, Homo sapiens
ggtcacagagagaaatggtagctgaagaagcagggcacgagggctctaac

SEQ ID NO: 6609 - DNA, 50 bp, Homo sapiens
tttccggtatattcgtgtgggttgactttttgtgtgtgtggttgtggtgg

SEQ ID NO: 6610 - DNA, 50 bp, Homo sapiens
ggatctcttgctcctctcacctgtgtgacagactactaacagcccaactg

SEQ ID NO: 6611 - DNA, 50 bp, Homo sapiens
acagtgtgggacagaagagtgctcagtgattaaatgcctgataatagatt

SEQ ID NO: 6612 - DNA, 50 bp, Homo sapiens
ctctctcgcaatttacaaccgctttcagtaccattcaccgtcactcctct

SEQ ID NO: 6613 - DNA, 50 bp, Homo sapiens
ctttggggagtggagttgttgtagatggggagagaatcagaacaaggaga

SEQ ID NO: 6614 - DNA, 50 bp, Homo sapiens
ccttactgcttacggtcatcggtcatcagcccaacccgcttggttaggtg

SEQ ID NO: 6615 - DNA, 50 bp, Homo sapiens
agagtataatttccccagtgtggagtggttagtgttgctaaagaagaggt

SEQ ID NO: 6616 - DNA, 50 bp, Homo sapiens
ctgatgtcgtgtctgcactcacctggtcatgtgttctgttgtgcggtagt

SEQ ID NO: 6617 - DNA, 50 bp, Homo sapiens
aggggcagagaagaatccacactcacaagagatgaccaggagtaaaactg

SEQ ID NO: 6618 - DNA, 50 bp, Homo sapiens
cccagcagaggccaacaagcagccatacccaaacttcagccaaaataaaa

SEQ ID NO: 6619 - DNA, 50 bp, Homo sapiens
tgtgcaaatacggcgagaagaagtgcatgagaaagtgctttataagctgt

SEQ ID NO: 6620 - DNA, 50 bp, Homo sapiens
ccagcttttcctttgatgttagttagcagtaagtcacaggtttgagcccc

SEQ ID NO: 6621 - DNA, 50 bp, Homo sapiens
ggcacgcatcctcattcctgcatgctcttagaatatctatcaatgatcat

SEQ ID NO: 6622 - DNA, 50 bp, Homo sapiens
acttctatactcagtgcgctgtgggtaaccaagcaagcaggtttgttgtc

SEQ ID NO: 6623 - DNA, 50 bp, Homo sapiens
gcgggatggtgggaagacagacactgccttagagcatgaataattgaaga

SEQ ID NO: 6624 - DNA, 52 bp, Homo sapiens
aggtagactatttagctggaagcatccaaacaggggattttaaaaatactca

SEQ ID NO: 6625 - DNA, 52 bp, Homo sapiens
aaaatgtaggttaaaactctcacttaagaaggagaagatctgagtaaaccca

SEQ ID NO: 6626 - DNA, 50 bp, Homo sapiens
acctgaacaatgaatgaagaaaggaagacttggttcttctagctctggac

SEQ ID NO: 6627 - DNA, 50 bp, Homo sapiens
catggctcacaagctctaacactcccctccctccagatcctaagaagaag

SEQ ID NO: 6628 - DNA, 50 bp, Homo sapiens
tctgagcttcacttcaagaactggtagtccaaaagaactggttcgttcag

SEQ ID NO: 6629 - DNA, 50 bp, Homo sapiens
acttcactcactttttagcctgttcatatgagcttgtcagtgcttttgtt

SEQ ID NO: 6630 - DNA, 50 bp, Homo sapiens
tgaggaggatgggaggcgcacaggcaatttagctagatatagaaagagaa

SEQ ID NO: 6631 - DNA, 50 bp, Homo sapiens
agctgatttggattcttgcggtttgcatcggtctaatttatcaagtgtgt

SEQ ID NO: 6632 - DNA, 50 bp, Homo sapiens
tccatccttggaagcttgacaagcattcacactactggctcacctactat

SEQ ID NO: 6633 - DNA, 50 bp, Homo sapiens
tagcactgtagccagagtccctgcttgtaccaggaagctgggtggtggtt

SEQ ID NO: 6634 - DNA, 50 bp, Homo sapiens
tggatagtcagaattacgtgttttgtggattggggagggaggggaggaaa

SEQ ID NO: 6635 - DNA, 50 bp, Homo sapiens
gcactcctggaaccttctcactaattcggggaccagttttgtgaatgttg

SEQ ID NO: 6636 - DNA, 50 bp, Homo sapiens
ttgctgcggatgacctgactgagccctgggagactgtgctataatctctc

SEQ ID NO: 6637 - DNA, 50 bp, Homo sapiens
agaaggaggatctgttctaaacatctgcgaggggaggacaaagcattgaa

SEQ ID NO: 6638 - DNA, 50 bp, Homo sapiens
cttgcatctgagtgaagatgaacctttctttcccagccctgagagaggga

SEQ ID NO: 6639 - DNA, 50 bp, Homo sapiens
gtctagctggcaggtgatggatgaatggatgagctggcagaccaacagaa

SEQ ID NO: 6640 - DNA, 50 bp, Homo sapiens
tgcatggaaatgtttcgagtacggggaaaataagggagccaaaactgtgt

SEQ ID NO: 6641 - DNA, 50 bp, Homo sapiens
ttttaaggtgtgactcaatttacaggcattctgtatttttgcgatttggt

SEQ ID NO: 6642 - DNA, 50 bp, Homo sapiens
acctttgggagaaagtcttacaactacatgaaatgcagatttatggactc

SEQ ID NO: 6643 - DNA, 50 bp, Homo sapiens
gaagggacagaacaatcaactgtgagagatgggaagaaaactcaaatgga

SEQ ID NO: 6644 - DNA, 50 bp, Homo sapiens
ctagtttggggactttcattgggcacgtgaatccaggagggctgaatttt

SEQ ID NO: 6645 - DNA, 50 bp, Homo sapiens
ggcccagattgtagacagcataaaaataattttgggcttttcctgttaaa

SEQ ID NO: 6646 - DNA, 50 bp, Homo sapiens
ctgggcttcttgtgtgagaagcaccgcagccaagaacaaccagtgcaact

SEQ ID NO: 6647 - DNA, 50 bp, Homo sapiens
gaagggggattcggtgatgggggaagccaagggacaagggaaaaaggaaa

SEQ ID NO: 6648 - DNA, 50 bp, Homo sapiens
aacccaaccatgaaaaagaagaagctctggactacggccaggcgtgggag

SEQ ID NO: 6649 - DNA, 50 bp, Homo sapiens
tggctatttgagttttctcttacatgaaatgcctggcaacgtacactggc

SEQ ID NO: 6650 - DNA, 50 bp, Homo sapiens
tgaactctgatttccgccgaaactaggaggaaacacccaaaagaagacgg

SEQ ID NO: 6651 - DNA, 50 bp, Homo sapiens
tttgctgggactaaaatcaaaactgcactgcagagcaggtgagggttcat

SEQ ID NO: 6652 - DNA, 58 bp, Homo sapiens
tggagagtgtgtgtattaccatttttttacattgcatcacattttaccatctatatct

SEQ ID NO: 6653 - DNA, 50 bp, Homo sapiens
tttgaagcccctcatagagaagagactgtaccataagagaagcccactca

SEQ ID NO: 6654 - DNA, 50 bp, Homo sapiens
aactctcagtccatgagcttgattactccattgtaccatttggaagccca

SEQ ID NO: 6655 - DNA, 50 bp, Homo sapiens
gtgggtagccattaagtggtctggcacagaaagggacaagtagcttcaag

SEQ ID NO: 6656 - DNA, 50 bp, Homo sapiens
ctggtgctgagtggagtcacagtaaggctgtagatggagcgccctgggaa

SEQ ID NO: 6657 - DNA, 50 bp, Homo sapiens
ttttgatgtgaccagtcgtgcatggcgggggacaggagcttagggggaat

SEQ ID NO: 6658 - DNA, 50 bp, Homo sapiens
attatgcatgtcgaggggacaacttttattaaacaggaggggtgtgtctt

SEQ ID NO: 6659 - DNA, 50 bp, Homo sapiens
tggtcatgtttccctctttactccacgacagtttcattattgtaaccagg

SEQ ID NO: 6660 - DNA, 50 bp, Homo sapiens
ttctgttggttatatgaatggcagttattgtctcccagtgtgtgggttct

SEQ ID NO: 6661 - DNA, 50 bp, Homo sapiens
agtcctggcaactttacctgggaattgtctgtaatctttaagcagtggcg

SEQ ID NO: 6662 - DNA, 50 bp, Homo sapiens
aggacttatctagctttcacagattcagagtgcgtttcaaacatcattgt

SEQ ID NO: 6663 - DNA, 50 bp, Homo sapiens
tttaacaggcttatctaggacataggcccaagagggaggaggaggaaggc

SEQ ID NO: 6664 - DNA, 50 bp, Homo sapiens
ctccaggccgaacgagcctccactctggattaagatctgtcatcttgaca

SEQ ID NO: 6665 - DNA, 50 bp, Homo sapiens
gcaggacttgtggcaggactcaacgggagagaaagaggctgaaacataaa

SEQ ID NO: 6666 - DNA, 50 bp, Homo sapiens
aagaacatcccaacttttccggtaggcaagtgtcaagtcacctggacaat

SEQ ID NO: 6667 - DNA, 50 bp, Homo sapiens
tctgtggcttgttgtgggaccctgcgccctttaaattagggcatatttta

SEQ ID NO: 6668 - DNA, 50 bp, Homo sapiens
gcgctaaaaacctggtgattaaatgacaaacagaacgtgagaagagattt

SEQ ID NO: 6669 - DNA, 50 bp, Homo sapiens
tcctgcacacaacaaataaagacaagaataaagggccacccatcagtagc

SEQ ID NO: 6670 - DNA, 50 bp, Homo sapiens
atgttgttcaaattaaacatcataccacatgggggcagctaccaattttt

SEQ ID NO: 6671 - DNA, 50 bp, Homo sapiens
taatatgaaaagctggaaaagaattaaggggttgaggagacgtgccgggt

SEQ ID NO: 6672 - DNA, 50 bp, Homo sapiens
gttaccctgacgaatgcagtcctcgtgtggaatgtctatgccctcttgag

SEQ ID NO: 6673 - DNA, 50 bp, Homo sapiens
acaccagcagtcataggggaaaggggaatacagttaattgggtatttgtt

SEQ ID NO: 6674 - DNA, 50 bp, Homo sapiens
actccctcccatctctggtctttagttggaagcaagctttcggacaacgg

SEQ ID NO: 6675 - DNA, 50 bp, Homo sapiens
tccaacaagggttacggcagaatttatgcgaaagtcttctttgggctaaa

SEQ ID NO: 6676 - DNA, 50 bp, Homo sapiens
ttgttctgctcaggccaaggattgttgtgtgctctgtatttgctgctttg

SEQ ID NO: 6677 - DNA, 50 bp, Homo sapiens
ggcccggcatgtcttcgttttgtcagtcctcatccaatccatcttcatat

SEQ ID NO: 6678 - DNA, 50 bp, Homo sapiens
gtgggtttttagacacctgcagcaagaagaaatactgactgactaggcat

SEQ ID NO: 6679 - DNA, 50 bp, Homo sapiens
ttttaaagaaaaatctattatcttggagcatggatgggggaatgcgaagg

SEQ ID NO: 6680 - DNA, 50 bp, Homo sapiens
cagaagaaacatggcaaactgctctgtgctttcaaaccaaagtgttcccc

SEQ ID NO: 6681 - DNA, 50 bp, Homo sapiens
gttacttaagatcagtatgtgtggtgcatatgtgatttcgaccattcagt

SEQ ID NO: 6682 - DNA, 50 bp, Homo sapiens
gagaatttccgtctgatctatgacaccaagggtcgctttgctgtacctcg

SEQ ID NO: 6683 - DNA, 50 bp, Homo sapiens
ctgggttaatactcaccaactttgagaaggttggtctctgctcttctgta

SEQ ID NO: 6684 - DNA, 50 bp, Homo sapiens
ggaaagacaggtgagtgtgccacaactacctaacacatcagcaaatctgg

SEQ ID NO: 6685 - DNA, 50 bp, Homo sapiens; identical to SEQ ID NO: 378

SEQ ID NO: 6686 - DNA, 50 bp, Homo sapiens
cgataagctgtggtgttgggagtgagagatgttactttgcgaatgttcaa

SEQ ID NO: 6687 - DNA, 50 bp, Homo sapiens
aaaggctaggtttgcgaaagcccttctaaaactatgctttggtggttact

SEQ ID NO: 6688 - DNA, 50 bp, Homo sapiens
ctgaccctgccgggcggaagataaaacaaaaacgagaagaacaagcaaga

SEQ ID NO: 6689 - DNA, 50 bp, Homo sapiens
aagattgtaaaaatacattttaggctcaagagttccaggggtttcagagc

SEQ ID NO: 6690 - DNA, 50 bp, Homo sapiens
tgcaagctggcaccttcacgtttatttttaaagggcttcacatcaaagat

SEQ ID NO: 6691 - DNA, 50 bp, Homo sapiens
aaacaaagaaggaaaatgaagagggggaaaagatgaacatcaggctgggt

SEQ ID NO: 6692 - DNA, 50 bp, Homo sapiens
tccaaaggatgttctggtgttgcagcatgatttctggtgttagtctttct

SEQ ID NO: 6693 - DNA, 50 bp, Homo sapiens
tttgtgggtgcgtgagaggggatttatactccttgagccatattttgtga

SEQ ID NO: 6694 - DNA, 50 bp, Homo sapiens
gggttcacagcatgggtggaggtaagtagtattctcattggttggttagt

SEQ ID NO: 6695 - DNA, 50 bp, Homo sapiens
gacagtgagaagaatatggagtagagtccttttggtctttgaggcggtca

SEQ ID NO: 6696 - DNA, 50 bp, Homo sapiens
aacagctgaagaacaagaaggtgagctctgaatgcgtcaggtggtcattc

SEQ ID NO: 6697 - DNA, 50 bp, Homo sapiens
ggctgaccagtacaggcttgggaattttatggttgggtggtttctaccaa

SEQ ID NO: 6698 - DNA, 50 bp, Homo sapiens
gggggagctatattactgattaaaaccaccatttcttcacccaacttatg

SEQ ID NO: 6699 - DNA, 50 bp, Homo sapiens
aagtcttgtattatgaggtactggggctctgggggatattgagatgagaa

SEQ ID NO: 6700 - DNA, 50 bp, Homo sapiens; identical to SEQ ID NO: 382

SEQ ID NO: 6701 - DNA, 50 bp, Homo sapiens
ggagcttccagtctaatagaaaagatgcacttacgaatagactttgggta

SEQ ID NO: 6702 - DNA, 50 bp, Homo sapiens
tctgtgctctgtggacccgtcaccctgagctcctcagttgctgaaccatc

SEQ ID NO: 6703 - DNA, 50 bp, Homo sapiens
tgctggcatgtggatagactttagcaaatggtagtcatcttctaatttct

SEQ ID NO: 6704 - DNA, 50 bp, Homo sapiens
aatgggaatcttaaggcctctctggaaagggtgtgagggggtcgaggggg

SEQ ID NO: 6705 - DNA, 50 bp, Homo sapiens
tgcatattgtcactgactggctagggtctctaaatttatgaaaccttaca

SEQ ID NO: 6706 - DNA, 52 bp, Homo sapiens
gtcagcaactaaaaagggagatatatcttagagagactggaataagcaactc

SEQ ID NO: 6707 - DNA, 50 bp, Homo sapiens
ggaaggactcaaactggccataaaggcaatacggcatgttcattacacca

SEQ ID NO: 6708 - DNA, 50 bp, Homo sapiens
tttgttgactatgaaatagtggtcctggttttaactctttggggttccct

SEQ ID NO: 6709 - DNA, 50 bp, Homo sapiens
aattatattttaggctgatgtgggtggtctgtaatgctctcatttaccac

SEQ ID NO: 6710 - DNA, 50 bp, Homo sapiens
ctgtgtttctgtatggtattgcatttgtcccggcctgttgggtttggtgg

SEQ ID NO: 6711 - DNA, 50 bp, Homo sapiens
ttcatgctcattaggacattgaacaaatggcagagtaagaaagtttggcc

SEQ ID NO: 6712 - DNA, 50 bp, Homo sapiens
gggaatggactcatatgcaagattgctgacttcggattggcccgattgat

SEQ ID NO: 6713 - DNA, 50 bp, Homo sapiens
caacacatgggacgggaaggaaatccttccgtgtgattttgttaaaaata

SEQ ID NO: 6714 - DNA, 50 bp, Homo sapiens
cagccacctcctcaggtcagacaagcccagcacccaaataccactatctg

SEQ ID NO: 6715 - DNA, 50 bp, Homo sapiens
ggcttccctattacctcccagcgaaattcgtagtctttctctatggagtt

SEQ ID NO: 6716 - DNA, 50 bp, Homo sapiens
tgctgatgtgttaggtagttgtggcacactcacctgtctttcctaaatgc

SEQ ID NO: 6717 - DNA, 50 bp, Homo sapiens
ttcatgctcagcaaaacaacgttttaggatggtgagagaagacaaagtaa

SEQ ID NO: 6718 - DNA, 50 bp, Homo sapiens
tattaaccactcacgggagctctccatgcatttggtattttcgtctgggg

SEQ ID NO: 6719 - DNA, 50 bp, Homo sapiens
ttacctgctttgcatgctctccatcgtcaaagtcttctggaaacttaggc

SEQ ID NO: 6720 - DNA, 50 bp, Homo sapiens
ccccaccccaacacatacaaacgtttcccaccaatccttgaactgcaaaa

SEQ ID NO: 6721 - DNA, 50 bp, Homo sapiens
ttcaaggtcccaatacccaactaactcgaaggaagaaatggaaatctatt

SEQ ID NO: 6722 - DNA, 50 bp, Homo sapiens
tgcacagaactcttacttacatgtctcatcgaaactccagaacaccgtcg

SEQ ID NO: 6723 - DNA, 50 bp, Homo sapiens
tgcatgtatcccggtaattcaaatccaatttcacagccactgctgaatat

SEQ ID NO: 6724 - DNA, 50 bp, Homo sapiens
tacaggaaaatgaaactagacgggtgggggacactagaatgaaaaccagt

SEQ ID NO: 6725 - DNA, 50 bp, Homo sapiens
agtttctgctttcagtgactgaggctttgctttaacctggtgactcccaa

SEQ ID NO: 6726 - DNA, 50 bp, Homo sapiens
tcccacttcaagttaagcaccaaagcaatcactaattctggagcacagga

SEQ ID NO: 6727 - DNA, 50 bp, Homo sapiens
catggatgggggcagtggtgtttctagtgtgtgaggaagcagagcagatg

SEQ ID NO: 6728 - DNA, 50 bp, Homo sapiens
tcaccacagatgggaagatcgtttcctgaaaacagtctataaatcacaga

SEQ ID NO: 6729 - DNA, 50 bp, Homo sapiens
cagacgctccagtgctgccgaggttagtgtgtttattagacctgaaatga

SEQ ID NO: 6730 - DNA, 50 bp, Homo sapiens
ccctttaggcctcttgcccgaacagtgaacactaatagatatcctaagct

SEQ ID NO: 6731 - DNA, 50 bp, Homo sapiens
atggggatcatgttttatttttctctatataatgggccagtgtgttccca

SEQ ID NO: 6732 - DNA, 50 bp, Homo sapiens
agctgtagaccataagccaccttcaggtagtggtttgggaaatcaagcaa

SEQ ID NO: 6733 - DNA, 50 bp, Homo sapiens
tgtacttatgcttgtcttctctacctgcccccagtcttgaagtggtggaa

SEQ ID NO: 6734 - DNA, 50 bp, Homo sapiens
ggagggtgtgggaagcaagagaagaacattctgttaggggcagagaagaa

SEQ ID NO: 6735 - DNA, 50 bp, Homo sapiens
gcatctccagctttcatagttacccaacttgtaaaccagaagatgtgctg

SEQ ID NO: 6736 - DNA, 50 bp, Homo sapiens
ggccagtgccagacggtagctagttggatgctaaaggtagaatttagata

SEQ ID NO: 6737 - DNA, 50 bp, Homo sapiens
ggcattgtaggttgacaccagcaaagactcagagtgacttgagcattgga

SEQ ID NO: 6738 - DNA, 50 bp, Homo sapiens
agcccatttggatatggcccatctttacctaatggctactatagtgaggt

SEQ ID NO: 6739 - DNA, 50 bp, Homo sapiens; identical to SEQ ID NO: 4953

SEQ ID NO: 6740 - DNA, 50 bp, Homo sapiens
aatggtcaggcacaggtagaatcaaagtcctgtatgtatgttcacacaga

SEQ ID NO: 6741 - DNA, 50 bp, Homo sapiens
tacctgaaggtgtagagagtgcccgcatccagcaaggccaacagctccac

SEQ ID NO: 6742 - DNA, 50 bp, Homo sapiens
ctgtgtttttcccaaagcaacaatttcaaacaaagtgagagccactgaca

SEQ ID NO: 6743 - DNA, 50 bp, Homo sapiens
gactccgagctcaagtcagtctgtacccccaacccctaacccactgcatc

SEQ ID NO: 6744 - DNA, 50 bp, Homo sapiens
tgtaactgactttatgtatcactcaagtcttgcctttactgagtgcctga

SEQ ID NO: 6745 - DNA, 50 bp, Homo sapiens
tctctctaaccaaaactgtaatcttcaggaccagcaaactcagcccaagg

SEQ ID NO: 6746 - DNA, 50 bp, Homo sapiens
aactcttggttaaatgggttaatagaggattggaacactttgtttgctgt

SEQ ID NO: 6747 - DNA, 50 bp, Homo sapiens; identical to SEQ ID NO: 6540

SEQ ID NO: 6748 - DNA, 50 bp, Homo sapiens
ggactaacttccacctcctctgctacttccagctgcttctaatcacactt

SEQ ID NO: 6749 - DNA, 50 bp, Homo sapiens
agtcttccacccagcataggtatcacacaaccagctctgttttactcctg

SEQ ID NO: 6750 - DNA, 50 bp, Homo sapiens
ttagctggtacattgttcagagtttactgggagccggtaagatagtcacc

SEQ ID NO: 6751 - DNA, 50 bp, Homo sapiens
agcgtgatgcttcctcatgtcggtgattttctgttgagacatcttcaagc

SEQ ID NO: 6752 - DNA, 56 bp, Homo sapiens
cagggttaacaaaagtatggaattcaattctttttatatgctgcagccatgttcct

SEQ ID NO: 6753 - DNA, 50 bp, Homo sapiens
tgtaattgatttccgcataaacggtcattactggcacctatggcagcacc

SEQ ID NO: 6754 - DNA, 50 bp, Homo sapiens
gtgatccacttggagctgctactggtcccattgagtcctatagtacttca

SEQ ID NO: 6755 - DNA, 50 bp, Homo sapiens
tgccatgaaatctctattaattctcagaaagatcaaaggaggtcccgtgt

SEQ ID NO: 6756 - DNA, 50 bp, Homo sapiens
cccacctggcaaatcctcaagtgtgaccctagtcatctttctccttttgg

SEQ ID NO: 6757 - DNA, 50 bp, Homo sapiens
gctaaacagaaaagaacctgaagtacagttcccgtcttcaaagaagatgc

SEQ ID NO: 6758 - DNA, 50 bp, Homo sapiens
atcctcctcccctgggatggcatagaagagactttaaaaccaaatgagcc

SEQ ID NO: 6759 - DNA, 50 bp, Homo sapiens
gtcagtaagctctgcctgccaagaagacacagtgagaggtgtccacagtc

SEQ ID NO: 6760 - DNA, 50 bp, Homo sapiens
gtttccacttagttacttcttcctacctgctgtgaagctctgcaccctgc

SEQ ID NO: 6761 - DNA, 50 bp, Homo sapiens
agagtaatccacatcccagggacagtcacaatgacctacggctttagctg

SEQ ID NO: 6762 - DNA, 50 bp, Homo sapiens
gcagggctacaccaagtccattgatatttggtctgtaggctgcattctgg

SEQ ID NO: 6763 - DNA, 50 bp, Homo sapiens
tcttctctaaaatgccctcctctccttcctttttccagacctggtttaaa

SEQ ID NO: 6764 - DNA, 50 bp, Homo sapiens
tcgccatttggtagttccacagtgactgctcttctattttacgaagccac

SEQ ID NO: 6765 - DNA, 50 bp, Homo sapiens
gtagattactatgagaccagcagcctctgctcccagccagctgtggtgtg

SEQ ID NO: 6766 - DNA, 50 bp, Homo sapiens
tttccttttcgctgactttctcactcactgtctgtctctcattttctcca

SEQ ID NO: 6767 - DNA, 50 bp, Homo sapiens
tggtaagtttctggcagtgtggagacaggggaataatctcaacagtaggt

SEQ ID NO: 6768 - DNA, 50 bp, Homo sapiens
ccatggtggtgcttgactttgctttggggcttaatcctagtatcatttgg

SEQ ID NO: 6769 - DNA, 50 bp, Homo sapiens
tcagtgggtgttggttgtccattagttgagacttagttgttgctctggga

SEQ ID NO: 6770 - DNA, 50 bp, Homo sapiens
ggctggacagcagatgattcaaatctcaatactacatgcccattctgtgg

SEQ ID NO: 6771 - DNA, 50 bp, Homo sapiens
caggatggaacaagactccagcccctgcctgtctcatgtatctgcaaggg

SEQ ID NO: 6772 - DNA, 50 bp, Homo sapiens
cttcagtgcgtacacgagctcaacgttagtgccaggaaagacaactactc

SEQ ID NO: 6773 - DNA, 50 bp, Homo sapiens
actcgtatgccaactcttctgtcttcactactagagtgtagattggactc

SEQ ID NO: 6774 - DNA, 50 bp, Homo sapiens
tggactggaacttgactcgaagttatgtggcttaatgagtaagttcagcc

SEQ ID NO: 6775 - DNA, 50 bp, Homo sapiens
actggttcatttgtttcccgatagagctttattggaggaggcttgagagc

SEQ ID NO: 6776 - DNA, 50 bp, Homo sapiens
accatctcctttaatcctcacagtgatcctggagcaatgtgtgcattcct

SEQ ID NO: 6777 - DNA, 50 bp, Homo sapiens
catcacctgctcacctaggaaccaggagtactgggaactgttccgttact

SEQ ID NO: 6778 - DNA, 50 bp, Homo sapiens
tcattgctgatgatcttgaggctgttgtcgaacttctcatggttcacacc

SEQ ID NO: 6779 - DNA, 50 bp, Homo sapiens
tggcaccacgctgattattttccttttcaaatcccagcctatacacctcc

SEQ ID NO: 6780 - DNA, 50 bp, Homo sapiens; identical to SEQ ID NO: 327

SEQ ID NO: 6781 - DNA, 50 bp, Homo sapiens
aggcctttttatttgtctgtttagatacactgcttcctatatctgctgga

SEQ ID NO: 6782 - DNA, 50 bp, Homo sapiens
cccgtgccccaccagtctcactgcctgactccaagtctcgtacactagat

SEQ ID NO: 6783 - DNA, 50 bp, Homo sapiens
agcgatgaactgttgcaaaagaattttccagagcattttccattaaacca

SEQ ID NO: 6784 - DNA, 50 bp, Homo sapiens
ccatattcttgttccccagccaggtgctgcacctccccactcttttagtg

SEQ ID NO: 6785 - DNA, 50 bp, Homo sapiens
aaatgcttaaaggaacaatatatgtccctttcgaggcacgtgattcgttt

SEQ ID NO: 6786 - DNA, 50 bp, Homo sapiens
tctggagccacacccttaccatcaccttccaaagaagaaattgaaccctt

SEQ ID NO: 6787 - DNA, 50 bp, Homo sapiens
aatcacacaaggtcgaaagtagacagtcctcttggacttggaattgtcca

SEQ ID NO: 6788 - DNA, 50 bp, Homo sapiens
actttcctccgggaagtttgtatcttagcgtggacaacaggttaacacaa

SEQ ID NO: 6789 - DNA, 50 bp, Homo sapiens
tcaggatgctctcactttaagaaccgggcaaataatagaacactgtgaca

SEQ ID NO: 6790 - DNA, 50 bp, Homo sapiens
acttcactcagagtaaatgaaaagactgggtgcctcatcaatatcattgt

SEQ ID NO: 6791 - DNA, 50 bp, Homo sapiens
tgactgaaggcaagctcacagatgaagcagaggactgaagatctcgatct

SEQ ID NO: 6792 - DNA, 50 bp, Homo sapiens
gctgagaaggatgtggtataaatgtattaagcagcttagggtctctggcc

SEQ ID NO: 6793 - DNA, 50 bp, Homo sapiens
aagtccccgtctagtgggaaagaaagaagttgaacaagtaattccaaggg

SEQ ID NO: 6794 - DNA, 50 bp, Homo sapiens
cgcccggcaagtactggggtttcttatagcttctctctgcatctacaaag

SEQ ID NO: 6795 - DNA, 54 bp, Homo sapiens
ctgtttctctattttaacttacattggttattctgtaaagtcagatgtggcagt

SEQ ID NO: 6796 - DNA, 50 bp, Homo sapiens
gcactgtccttcccagttctacatttgagtctgagttgactcgcaagact

SEQ ID NO: 6797 - DNA, 50 bp, Homo sapiens
aacagattgtgcttctgttctgaatcttctaaagccatctgcacagtgct

SEQ ID NO: 6798 - DNA, 50 bp, Homo sapiens
aacagattgtgcttctgttctgaatcttccaaagccatctgcacagtgct

SEQ ID NO: 6799 - DNA, 50 bp, Homo sapiens
atctgcacagtgttagcatggtgactccagtgtcctccaagactccatag

SEQ ID NO: 6800 - DNA, 50 bp, Homo sapiens
tttagcatccactagttactgtctggcactggccacgaagggtgacaggg

SEQ ID NO: 6801 - DNA, 50 bp, Homo sapiens
gaatcccggtcatctctacccaagtcccggtctctctaccctattctctc

SEQ ID NO: 6802 - DNA, 50 bp, Homo sapiens
tggtaacttcaaagtccctaacacattcgatatttctcctagcttccact

SEQ ID NO: 6803 - DNA, 50 bp, Homo sapiens
actcccaccaaaccccactttgtaatcactggtagtaaagagagatgcag

SEQ ID NO: 6804 - DNA, 50 bp, Homo sapiens
aagagtaagaggcaacagatagagtgtccttggtaataagaagtcagaga

SEQ ID NO: 6805 - DNA, 50 bp, Homo sapiens
gaaattggaaggtgatacttggggaccacaacacgcacatctgggaactg

SEQ ID NO: 6806 - DNA, 50 bp, Homo sapiens
tcatctgtggcatacagaatgtctacaatcttctgcaatacagggtcgtt

SEQ ID NO: 6807 - DNA, 50 bp, Homo sapiens
ggcaagggaacaaacttgagtaaatctagctcttgaagggctcgggaccc

SEQ ID NO: 6808 - DNA, 50 bp, Homo sapiens
actcatttgtctcctcattctcaaaagtcttctgtggtttggcttcagtg

SEQ ID NO: 6809 - DNA, 50 bp, Homo sapiens
tcgatgggccattatccactctgctatcttctgaagagtaattttcacct

SEQ ID NO: 6810 - DNA, 50 bp, Homo sapiens
aaggacggaactcacacatcttctttagacagaaatgtagtctcactgca

SEQ ID NO: 6811 - DNA, 50 bp, Homo sapiens
tataatcccagtccatgagggtgtaaagtgaaatgagctggctggctgga

SEQ ID NO: 6812 - DNA, 50 bp, Homo sapiens
gctctgttctggggttggtccaaagtcaggtggagttccaatgtatgaaa

SEQ ID NO: 6813 - DNA, 50 bp, Homo sapiens
tccctgagatctaggagggcagcatagtatcatttttgtattccggtgct

SEQ ID NO: 6814 - DNA, 50 bp, Homo sapiens
agctgctacaaagaagacatgttttagacaaatactcatgtgtatgggca

SEQ ID NO: 6815 - DNA, 50 bp, Homo sapiens
agggatctgaatacttcgggtgcaaaaattttcctgcagtttagatttgc

SEQ ID NO: 6816 - DNA, 50 bp, Homo sapiens
tatggtttccaatatcgacatggcatcattggttacattagcactgggcc

SEQ ID NO: 6817 - DNA, 50 bp, Homo sapiens
ggcctgggcatagactgtggtgaggtcactagattatcttgttcttcccc

SEQ ID NO: 6818 - DNA, 50 bp, Homo sapiens
gagtcctgatctcagcttcatcaccaacattcctcgccttcagttgaatt

SEQ ID NO: 6819 - DNA, 50 bp, Homo sapiens
ggaggtctttgccaccaatgggagatgagcccaaactttcgatataggtg

SEQ ID NO: 6820 - DNA, 50 bp, Homo sapiens
accagaggtaaacttgagtgtaattgtcagacagacacacttttccacca

SEQ ID NO: 6821 - DNA, 53 bp, Homo sapiens
tgcattttacattagcttccaatatttatggcagtaaccaacagtattatcgt

SEQ ID NO: 6822 - DNA, 50 bp, Homo sapiens
tttccaatgctccttgctccattttaaacttgctgtcctttataagagaa

SEQ ID NO: 6823 - DNA, 50 bp, Homo sapiens
tgttttcacgatagaaataaggaaggtctagagcttctattctttggcca

SEQ ID NO: 6824 - DNA, 50 bp, Homo sapiens
tttcatacaaagccaacagaattcacagccacacactgcacaggtcatgt

SEQ ID NO: 6825 - DNA, 50 bp, Homo sapiens
aggaagctgtgagggtgggttcattagttgcagggatggtagttatgtca

SEQ ID NO: 6826 - DNA, 50 bp, Homo sapiens
gagacaagctggaaggccggacctcagaccggagggggtttatgtcattc

SEQ ID NO: 6827 - DNA, 50 bp, Homo sapiens
ataactagacaaggtctgagcactttgggtggggatggagtgagaaaggc

SEQ ID NO: 6828 - DNA, 50 bp, Homo sapiens
attaagttgggtaacgccagggttttcccagtcacgacgttgtaaaacga

SEQ ID NO: 6829 - DNA, 50 bp, Homo sapiens
gcgttctagctgggccaacagagcaggatttcgtttcagaaaacaaaaca

SEQ ID NO: 6830 - DNA, 50 bp, Homo sapiens
atcatgtctcattaacagagtgaagatggagcaacgtcatccagcttctg

SEQ ID NO: 6831 - DNA, 50 bp, Homo sapiens
tggtcgcgcccgaggtacggttttcatggtagggctgaatggaagatgtg

SEQ ID NO: 6832 - DNA, 50 bp, Homo sapiens
cagaaagataggagtgtgcaatggcaaggaaactcaatttaaagcaaatt

SEQ ID NO: 6833 - DNA, 50 bp, Homo sapiens
ttgcaaattctcatggtttgggttgggtggtggagagcgcgtgtcatctg

SEQ ID NO: 6834 - DNA, 50 bp, Homo sapiens
ttattcagcgtcacgatcagactgttacatttagcaatcaacagcatggg

SEQ ID NO: 6835 - DNA, 50 bp, Homo sapiens
tgtgtgtatgtgtgtaaccaggtctgactatagcttggtctgtctgtgtc

SEQ ID NO: 6836 - DNA, 50 bp, Homo sapiens
agcatttggggttttagctttggtgtcctaaatttcagtgatctttgcca

SEQ ID NO: 6837 - DNA, 50 bp, Homo sapiens
cataaaccagcagctcagcgtttctatagcaagcggtctcgagcacaagc

SEQ ID NO: 6838 - DNA, 50 bp, Homo sapiens
tagtgataggcgtggtggcggcgaaggtcagtaatggggcttttaaccag

SEQ ID NO: 6839 - DNA, 50 bp, Homo sapiens
tactgtagaaagaagaagagcacacatgagacagagaaggaggtggatgc

SEQ ID NO: 6840 - DNA, 50 bp, Homo sapiens
cgaggcggcccggcagggtaccaatttggatgaattcttgatagatttaa

SEQ ID NO: 6841 - DNA, 50 bp, Homo sapiens
ttgggttcagaatagcttcatctactgccgagcaaagtcaatacagcact

SEQ ID NO: 6842 - DNA, 50 bp, Homo sapiens
ggtaacagccatcccaccaccaataatcatctcattgtctttgtccagca

SEQ ID NO: 6843 - DNA, 50 bp, Homo sapiens
gtatgaatagattgccccattccctgccagcctggtagtgacttttccac

SEQ ID NO: 6844 - DNA, 50 bp, Homo sapiens
tataatttctaccaaactaagttttattttgtgcccgctccctgtccctt

SEQ ID NO: 6845 - DNA, 50 bp, Homo sapiens
ctgtaaaattcttttcgggtccatcctggctctcatctccagtgctttga

SEQ ID NO: 6846 - DNA, 56 bp, Homo sapiens
agggttaacaaaagtatggaattcaattctttttatatgctgcagccatgttcctg

SEQ ID NO: 6847 - DNA, 50 bp, Homo sapiens
cccaatctgaagtcagtaaatgaactaatctacaagcgtggttatggcaa

SEQ ID NO: 6848 - DNA, 50 bp, Homo sapiens
ccgaggtactctcttagagaaaggtgattggatgctccggttgcctgtaa

SEQ ID NO: 6849 - DNA, 50 bp, Homo sapiens
gcgggttggaaaatagtcgagaattgacagtccctctcgaagatgctttt

SEQ ID NO: 6850 - DNA, 50 bp, Homo sapiens
ttgagaccccaccaactgcaaaatctgttcctggcattaagctccttctt

SEQ ID NO: 6851 - DNA, 50 bp, Homo sapiens
aatgaaaaactccagctctcagctcacaaatctgtaatttaggtgtctct

SEQ ID NO: 6852 - DNA, 50 bp, Homo sapiens
tcgtcctggttaatctggaagtaacgtaattcgtaactctctttgctgtt

SEQ ID NO: 6853 - DNA, 50 bp, Homo sapiens
tcggttgttaagaactagagcttattcctattccaaatctatcttgcgct

SEQ ID NO: 6854 - DNA, 50 bp, Homo sapiens
agataagaacttcatcctaaagcatccgggccttggcatcttgtccatgc

SEQ ID NO: 6855 - DNA, 50 bp, Homo sapiens
actgatttcatcaagttcgacactggtaacctgtgtatggtgactggagg

SEQ ID NO: 6856 - DNA, 50 bp, Homo sapiens
aatcattggctacctcctccccttttacagtcacaagtccagatgtttgg

SEQ ID NO: 6857 - DNA, 50 bp, Homo sapiens
aataaatcccatacctcccattgaactaccacccaccccgaccaccataa

SEQ ID NO: 6858 - DNA, 50 bp, Homo sapiens
caagacatttccagccaacttcagaatgtagatctttgagccagacagct

SEQ ID NO: 6859 - DNA, 50 bp, Homo sapiens
gaggtactggcctgtgaagccctgaaggcactggcactggtaggaaccag

SEQ ID NO: 6860 - DNA, 50 bp, Homo sapiens
atcttctgtcaaagtcagtcgctgctccaagattgaaacagtctgtgtca

SEQ ID NO: 6861 - DNA, 50 bp, Homo sapiens
tggatggatttccaagtggcctcatatttatcatggtgctttaaatagca

SEQ ID NO: 6862 - DNA, 50 bp, Homo sapiens
ttcagcttagggaaagagagatacattttagattatagagcatcgcctgc

SEQ ID NO: 6863 - DNA, 50 bp, Homo sapiens
atcttcctatgtgcgccagataatgatcaagttcacaggtggtcttactt

SEQ ID NO: 6864 - DNA, 50 bp, Homo sapiens
agtttcttaagtcaaatgacacattagcccacgcaattcccagccccagc

SEQ ID NO: 6865 - DNA, 50 bp, Homo sapiens
ccctcttctgacatgaattaggcataatttagcaatcggttcttcccaaa

SEQ ID NO: 6866 - DNA, 50 bp, Homo sapiens
atacagtgaactggccactggctgtttgctatataaatggtatactgctt

SEQ ID NO: 6867 - DNA, 50 bp, Homo sapiens
aggttacttaaaagcatcattggcgtggtcctctcactaccaaagggcag

SEQ ID NO: 6868 - DNA, 50 bp, Homo sapiens
ctggggtcagcaaagaggggtagcaagtgtgccttagagatgaagaaatg

SEQ ID NO: 6869 - DNA, 50 bp, Homo sapiens
tttagagtacttagaggaggaccaggaaacactgagacagacacgcaggc

SEQ ID NO: 6870 - DNA, 50 bp, Homo sapiens
tgtttgaaaactaccttcatgggagcaatgacaagcacatgtctaggatt

SEQ ID NO: 6871 - DNA, 50 bp, Homo sapiens
tttgtgccaaggtttgggattttgtcttctagagcttcttctctattggt

SEQ ID NO: 6872 - DNA, 50 bp, Homo sapiens
tttttgacgctctctcactggtcttggcatttgatgtttctgttgaagcc

SEQ ID NO: 6873 - DNA, 50 bp, Homo sapiens
cctataatgggggaaagatgctggttagatgtttattttagtgggcttgc

SEQ ID NO: 6874 - DNA, 50 bp, Homo sapiens
ccacaaacacaccctgccacaagacatttagcacagaggaacagatccat

SEQ ID NO: 6875 - DNA, 50 bp, Homo sapiens
gacaccacaactcacctcctctattattagagatcccgagacattacggc

SEQ ID NO: 6876 - DNA, 50 bp, Homo sapiens
tgttacaatttcagcagttgaattcagtgaacactggttgaggagtgcct

SEQ ID NO: 6877 - DNA, 50 bp, Homo sapiens
ccttccgtattctcccaagtattcacaagccctcccttaaaaccctctct

SEQ ID NO: 6878 - DNA, 50 bp, Homo sapiens
acagccatctgggatgagccgcttttcagccaccatgtcttcaaattcat

SEQ ID NO: 6879 - DNA, 50 bp, Homo sapiens
taactgaatacagtctcatcttgccgcgcctggcttacctatctgtggaa

SEQ ID NO: 6880 - DNA, 50 bp, Homo sapiens
aggtactacacaaggtgtcagatggggttgccacaatgactaggacaaga

SEQ ID NO: 6881 - DNA, 50 bp, Homo sapiens; identical to SEQ ID NO: 363

SEQ ID NO: 6882 - DNA, 50 bp, Homo sapiens
gagagctttctccccgccttcagtttctgatggatctagccatgttgaaa

SEQ ID NO: 6883 - DNA, 50 bp, Homo sapiens
taaaactttctgccagggttccagagaaagagtaatttcctttgagtacc

SEQ ID NO: 6884 - DNA, 50 bp, Homo sapiens
cgctcgccgggccaggtaccaaaactttcataataaaaggtaggaaggat

SEQ ID NO: 6885 - DNA, 50 bp, Homo sapiens
tgacttcattgaaggctccatcacccaaagtagatgttaaaaaccttaat

SEQ ID NO: 6886 - DNA, 50 bp, Homo sapiens
tttatgtggaaggcttccctattacctcccagcgaaattcgtagtctttc

SEQ ID NO: 6887 - DNA, 50 bp, Homo sapiens
taaaatgttgccagtggaggaccgaatcaaggttattgctgacctcattt

SEQ ID NO: 6888 - DNA, 50 bp, Homo sapiens
agatatgttctgagccccgcccacacactgcctggttacagggagagaag

SEQ ID NO: 6889 - DNA, 50 bp, Homo sapiens
gaggttccttcatcccagaagaagcaacaggatttccagatcagggcaac

SEQ ID NO: 6890 - DNA, 50 bp, Homo sapiens
ctggtctgtgtcgttggctttatgacaggaagtgcctgtgggttatctta

SEQ ID NO: 6891 - DNA, 50 bp, Homo sapiens
cccaacgcttgtgtgcgtatgtatgtgtgtatttaacatcctgttcccat

SEQ ID NO: 6892 - DNA, 50 bp, Homo sapiens
gcataaaggcagccatttccattctctacattctctagtgatagcagagg

SEQ ID NO: 6893 - DNA, 50 bp, Homo sapiens
cgttacgcaatggagaagtccccttgaggctgaataatcacatctgtatc

SEQ ID NO: 6894 - DNA, 50 bp, Homo sapiens
aggccaaatcaccgcacagttgaattgctgattctaattggtaacaataa

SEQ ID NO: 6895 - DNA, 50 bp, Homo sapiens
ttgtagtgtaattgtgtgatacgcaaacctttagttaacccaagtgatga

SEQ ID NO: 6896 - DNA, 50 bp, Homo sapiens
ccttgttgccgtgggtatatgcatgatcttaccttttgtttgactatgaa

SEQ ID NO: 6897 - DNA, 50 bp, Homo sapiens
aaatgatatgttaagcacccaaatcttcacatggaggggaagggggtggg

SEQ ID NO: 6898 - DNA, 50 bp, Homo sapiens
ggccaaagctgtttattatgagatctttgagtggaatcagcatgtctccc

SEQ ID NO: 6899 - DNA, 50 bp, Homo sapiens
ttaacagcattgaaggtgaaacagcacaatgtcccattccaaatttattt

SEQ ID NO: 6900 - DNA, 50 bp, Homo sapiens
aggtacgaaaatacattctggcatcacacccctgaacccaagactgttct

SEQ ID NO: 6901 - DNA, 50 bp, Homo sapiens
gaactacctactggcagttgggttcagggagatgggattgacttcgcctt

SEQ ID NO: 6902 - DNA, 50 bp, Homo sapiens
agagctaatatacagagtacctgacacactacctcaccaacagtttaact

SEQ ID NO: 6903 - DNA, 50 bp, Homo sapiens
gcccaggcaacaagaatacttttatctttgatccgttctgtttatccagt

SEQ ID NO: 6904 - DNA, 50 bp, Homo sapiens
ctgagggtagactgtgggcaaagaggacaactctccctcccctaagggac

SEQ ID NO: 6905 - DNA, 50 bp, Homo sapiens
tgcccagacctatttccttaggacagtattctaaagttcagtagtccagt

SEQ ID NO: 6906 - DNA, 50 bp, Homo sapiens
gccctgtcccttgagaggctcacagcgatggaggccacttttgttgtttg

SEQ ID NO: 6907 - DNA, 50 bp, Homo sapiens
accaaaaagggctacattaccaccactgtatcataaaagccagccacctt

SEQ ID NO: 6908 - DNA, 50 bp, Homo sapiens
agctgacgattttctatcccggcctatagtgcatgtatggcaattgagca

SEQ ID NO: 6909 - DNA, 50 bp, Homo sapiens
ccccaaaacaaacaaaataaaccacaccagatatcagtcacatccttgaa

SEQ ID NO: 6910 - DNA, 50 bp, Homo sapiens
agtctgttattgcctgattttgtccccaccttgttcaaatttccaaagct

SEQ ID NO: 6911 - DNA, 50 bp, Homo sapiens
ctcacagccgaagctctgatcctttgttctcaggaaacactcaggaagtg

SEQ ID NO: 6912 - DNA, 50 bp, Homo sapiens
agagaaaatgagagacagacagtgagtgggaaagtcagcgaaaaggaaaa

SEQ ID NO: 6913 - DNA, 50 bp, Homo sapiens
tccttgagtttatacaccgtgctatgagtgatgacagccaattcccatgc

SEQ ID NO: 6914 - DNA, 50 bp, Homo sapiens
tcgcttcaggggtcagccaaaagatagacagccaggtaacttgagtggac

SEQ ID NO: 6915 - DNA, 50 bp, Homo sapiens
ggacagtaccaaacactcccctcctcccctctgcctctttgcttacttag

SEQ ID NO: 6916 - DNA, 50 bp, Homo sapiens
gaccaaatactgaacttccaccctgcataataatcatgaacaccgcacca

SEQ ID NO: 6917 - DNA, 50 bp, Homo sapiens
aggtgagcagtgcctcagatacctgcaaaacctttctgcacaaatgtgct

SEQ ID NO: 6918 - DNA, 50 bp, Homo sapiens
cagatccaatgagggtcccatctcttcccacttcaatcccgtgttgttct

SEQ ID NO: 6919 - DNA, 50 bp, Homo sapiens
ccaaccaaaccatcaaacagcagggagctagtgaagaggtctattgttcc

SEQ ID NO: 6920 - DNA, 50 bp, Homo sapiens
acatcgcctaaaaccgtgcatcgtaaacatttacctcaaagtcatcctct

SEQ ID NO: 6921 - DNA, 50 bp, Homo sapiens
ttttcactcctctcagagtctactccacctctcctcactccccaggacac

SEQ ID NO: 6922 - DNA, 50 bp, Homo sapiens
agatctgtgttcgtctctaggtaataggaaacacaatccagacatgatct

SEQ ID NO: 6923 - DNA, 50 bp, Homo sapiens
ttcatgaactcggagaggtccatggtgcactcccgctcgtcctgggacac

SEQ ID NO: 6924 - DNA, 50 bp, Homo sapiens
ctggcaatattaacttgggttctgtttcatctctggctataagccataca

SEQ ID NO: 6925 - DNA, 50 bp, Homo sapiens
tgccattcttttgttgaacctgtaaaggtaaggcccagattctgaaacct

SEQ ID NO: 6926 - DNA, 50 bp, Homo sapiens
taaagcacttatgagaatgctgcatttgtacatgagctacgcctcatctt

SEQ ID NO: 6927 - DNA, 50 bp, Homo sapiens
gcacccacctcctcagttcagacaagcccagcacccaaataccactatct

SEQ ID NO: 6928 - DNA, 50 bp, Homo sapiens
agcgcatgagtgactcccatctatatatgtcagtcgtctctggtgcaagg

SEQ ID NO: 6929 - DNA, 50 bp, Homo sapiens
gaaacagtggcccgggtcgtagtgcgctgtccagatcttcacgctacacc

SEQ ID NO: 6930 - DNA, 50 bp, Homo sapiens
agtgcattcacactgatgataaacgatagtagcttcacaggtttgcttct

SEQ ID NO: 6931 - DNA, 50 bp, Homo sapiens
gcttcaaaattccttacccccaacctctggcaccccaaattgtatcacta

SEQ ID NO: 6932 - DNA, 50 bp, Homo sapiens
gaggaagggctggctcttactccccacaagaggtgttccttaggccacac

SEQ ID NO: 6933 - DNA, 50 bp, Homo sapiens
ccaatctaatttaaaccctcataacaggacataagcttgcgcccgcatct

SEQ ID NO: 6934 - DNA, 50 bp, Homo sapiens
tgctcaatgttttgcactgattttattcaatgttttgaagggcgttatga

SEQ ID NO: 6935 - DNA, 50 bp, Homo sapiens
tgctaacaacagcttctcggtatgttaatattctgctaactcctttctca

SEQ ID NO: 6936 - DNA, 50 bp, Homo sapiens
ggaggaatggctgtgcccgtcccctccacttaagcgacctgagtctccag

SEQ ID NO: 6937 - DNA, 50 bp, Homo sapiens
acacacacttaagagtacagatgagagccaaaaataagtggcaggtcttt

SEQ ID NO: 6938 - DNA, 50 bp, Homo sapiens
ttttgtgactgtgcatgcttgaaaagaataagttttctgcagctgtgtct

SEQ ID NO: 6939 - DNA, 50 bp, Homo sapiens
cttgtctgtggcgtggcacacagtaggtgctcggtttgtgttgttgaatg

SEQ ID NO: 6940 - DNA, 50 bp, Homo sapiens
gaattctgaatacatgttggactgtgtttctttgacctgtgtttcctagg

SEQ ID NO: 6941 - DNA, 50 bp, Homo sapiens
tgagtccttggcctcagcttctaatctcaaacctaaaatagattgcgttt

SEQ ID NO: 6942 - DNA, 50 bp, Homo sapiens
tcttctcgtctttgctattaaatttcttcacggaccatgcatctggagga

SEQ ID NO: 6943 - DNA, 50 bp, Homo sapiens
ccagagactcctaagcagaatcaaggatgtgtggcataagcatgagagcc

SEQ ID NO: 6944 - DNA, 50 bp, Homo sapiens
cccataaagaggaataagctactgtcctcagctcttgttagctcaggctt

SEQ ID NO: 6945 - DNA, 50 bp, Homo sapiens
agagtttgtaacacaatccagtccacatgcttatccaatcccatcatcca

SEQ ID NO: 6946 - DNA, 50 bp, Homo sapiens
agctcaaaatatggcaaagtgatgatttcgtgttaatcctagaaacagca

SEQ ID NO: 6947 - DNA, 50 bp, Homo sapiens
tgggtctgctttcacatgaaagtgctacgaattctcttttgtgctgagcc

SEQ ID NO: 6948 - DNA, 50 bp, Homo sapiens
ggatgagcccactcacagcaccagatttgtactgaaagtaccttaatatc

SEQ ID NO: 6949 - DNA, 50 bp, Homo sapiens
aacccaaatccaaatgccaggatagaagaatttgtttatgagaaactgga

SEQ ID NO: 6950 - DNA, 50 bp, Homo sapiens
cgctttttgatctgattactatttcacacaggttacagctatgaccatga

SEQ ID NO: 6951 - DNA, 50 bp, Homo sapiens
ctgccgctaattcactagtaatttcgatcgtccgccctccaggtacatat

SEQ ID NO: 6952 - DNA, 50 bp, Homo sapiens
aggcgtgctattaattatcccataccctccttacagaaattacactcgca

SEQ ID NO: 6953 - DNA, 50 bp, Homo sapiens
gggagaagttctttaaactaagggtacaaaatgaattgaatgctgggggc

SEQ ID NO: 6954 - DNA, 50 bp, Homo sapiens
attagcgtgttcgcgcccgaggtacaccaaaaccttcagaaagcaaagtt

SEQ ID NO: 6955 - DNA, 50 bp, Homo sapiens
aagatatgaaatatgcctacccgcagagcttggcacaaagtggagtcaat

SEQ ID NO: 6956 - DNA, 50 bp, Homo sapiens
gtacagagatcggatcacacaagcccggagacagtgcagcttctccactg

SEQ ID NO: 6957 - DNA, 50 bp, Homo sapiens
aatgcacttgtgataaactgacagcagggttagacattactttcaaagct

SEQ ID NO: 6958 - DNA, 50 bp, Homo sapiens
ccactgctcaggaaactgcctgttcggtgctcctccaattcaattaagct

SEQ ID NO: 6959 - DNA, 50 bp, Homo sapiens
agtgctggtataactgcagaaagagatagagaagagagatcagtgagagc

SEQ ID NO: 6960 - DNA, 50 bp, Homo sapiens
aagtcaggacctttgcacttgccccgcctctgccttcacagctcttctca

SEQ ID NO: 6961 - DNA, 50 bp, Homo sapiens
taatcagggaagagcttgagatcattagcaactgaactgaacagggagtt

SEQ ID NO: 6962 - DNA, 50 bp, Homo sapiens
ctgggtcacgtcgcccaccaatggtatctgtgtggttaggcattaggctg

SEQ ID NO: 6963 - DNA, 50 bp, Homo sapiens
ggtggtaggtgagtgggtattgcgggctagtatccgagcaaaagatggtg

SEQ ID NO: 6964 - DNA, 50 bp, Homo sapiens
cagccctgctatctctggttgttcatgtacttctgtaaggtggagaccct

SEQ ID NO: 6965 - DNA, 50 bp, Homo sapiens
gaaggtgagaaacccgagagacaccaactatgatttttacttttcctggt

SEQ ID NO: 6966 - DNA, 50 bp, Homo sapiens
accacccctcccttccctcctttaactcatctcgaatctctctcatacat

SEQ ID NO: 6967 - DNA, 50 bp, Homo sapiens
ctcttatcctgctctgccctggaacttgaaccccagtgccaatactcatg

SEQ ID NO: 6968 - DNA, 50 bp, Homo sapiens
cgacctaatctctgtccccagaaggcagaccaggactccagccccaggag

SEQ ID NO: 6969 - DNA, 50 bp, Homo sapiens
gccaaatctttgtcctgtacaaagtacagatgtttttgactgaagttcca

SEQ ID NO: 6970 - DNA, 50 bp, Homo sapiens
gccacagtgaataaatacaaggcaaggctcataggtaaaacaagttctat

SEQ ID NO: 6971 - DNA, 50 bp, Homo sapiens; identical to SEQ ID NO: 5545

SEQ ID NO: 6972 - DNA, 50 bp, Homo sapiens
aaacccacccatcatttgccctgactacccatctcccgattaattcaccc

SEQ ID NO: 6973 - DNA, 50 bp, Homo sapiens
agggaacagagccaggatttaaactctaacaatttgtctccacaattgca

SEQ ID NO: 6974 - DNA, 50 bp, Homo sapiens
ctcctggcacgacagaactagtagtttccatgtcttgaggacataggtcc

SEQ ID NO: 6975 - DNA, 50 bp, Homo sapiens
tcgaacctgttccaggtatgctgatagatgtcggtagggcatccttaatt

SEQ ID NO: 6976 - DNA, 50 bp, Homo sapiens
gaggtactataaaccagatgcccaaaacacctgccctcctgggttggccg

SEQ ID NO: 6977 - DNA, 50 bp, Homo sapiens
acattcatctgtttccactgaggtctgagtcttcaagttttcaccccagc

SEQ ID NO: 6978 - DNA, 50 bp, Homo sapiens
ttagcccttttctgcgctaattagaatttcaagcgtcacagagcctgggg

SEQ ID NO: 6979 - DNA, 50 bp, Homo sapiens
ttcaacgaggtgaaccagtgtgatgtctgtggggaaaacacgtagtcagg

SEQ ID NO: 6980 - DNA, 53 bp, Homo sapiens
ggaaaaaagaaatttcctgagatttccagtgtatacagaagtgtctttccatt

SEQ ID NO: 6981 - DNA, 50 bp, Homo sapiens
gagttcacgtggggtggccctcctcagtgctcttagggtactgtactgtc

SEQ ID NO: 6982 - DNA, 50 bp, Homo sapiens
ccaccttcgaggtcccttccggcctaagatgcctgaaatctccaaggaaa

SEQ ID NO: 6983 - DNA, 50 bp, Homo sapiens
acaaggcaaagcttaaagaaacactaaacgaatgagtgaaagaagcggag

SEQ ID NO: 6984 - DNA, 50 bp, Homo sapiens
ttctcaataacaaacccagggctttcataaatgcatgatcaaaatgtgga

SEQ ID NO: 6985 - DNA, 50 bp, Homo sapiens
acagaaaatagggtgtatatcagcattacgctgattcagcagaagatagc

SEQ ID NO: 6986 - DNA, 50 bp, Homo sapiens
tctcgactgacacccactataaattccctgggttgaaaaacttttctttt

SEQ ID NO: 6987 - DNA, 50 bp, Homo sapiens
tccaaacccctccattacaatctaacacacttccccctacatcgtctcct

SEQ ID NO: 6988 - DNA, 50 bp, Homo sapiens
gcatttattttcttctacagagaacctggcggctgggtctgggaaagagc

SEQ ID NO: 6989 - DNA, 50 bp, Homo sapiens
acccacaattagtgagagtgcccttgagcttgagattcccattcctcctt

SEQ ID NO: 6990 - DNA, 50 bp, Homo sapiens
tggatataaagtgtgtgttctgacagaaaatggggagaaggtggctattt

SEQ ID NO: 6991 - DNA, 50 bp, Homo sapiens
gccagaaaatcctggtttccctggtgtcccctccaatctcttttaccaaa

SEQ ID NO: 6992 - DNA, 50 bp, Homo sapiens
ccattgtcgcccggagctggaaagatagtttagagaatgccttagcactt

SEQ ID NO: 6993 - DNA, 50 bp, Homo sapiens
cagcacccagtacaggtatgcaggaaggactcgcttgacttagagagtgg

SEQ ID NO: 6994 - DNA, 50 bp, Homo sapiens
aacacaccagaaggaaaagacacagacagggaatgaagcctgcaaagtcc

SEQ ID NO: 6995 - DNA, 50 bp, Homo sapiens
gtaactcagtgcccccaaagattcatagtcagcaggattggccagcaaat

SEQ ID NO: 6996 - DNA, 50 bp, Homo sapiens
cgccccaaatataaaatctcaataccagttccttttccccagtaccccag

SEQ ID NO: 6997 - DNA, 50 bp, Homo sapiens
agtcacaggatgttctctgcacctcatctgcaactctgagccttactcaa

SEQ ID NO: 6998 - DNA, 50 bp, Homo sapiens
gttagagccctcgtgccctgcttcttcagctaccatttctctctgtgacc

SEQ ID NO: 6999 - DNA, 50 bp, Homo sapiens
ccaccacaaccacacacacaaaaagtcaacccacacgaatataccggaaa

SEQ ID NO: 7000 - DNA, 50 bp, Homo sapiens
cagttgggctgttagtagtctgtcacacaggtgagaggagcaagagatcc

SEQ ID NO: 7001 - DNA, 50 bp, Homo sapiens
aatctattatcaggcatttaatcactgagcactcttctgtcccacactgt

SEQ ID NO: 7002 - DNA, 50 bp, Homo sapiens
agaggagtgacggtgaatggtactgaaagcggttgtaaattgcgagagag

SEQ ID NO: 7003 - DNA, 50 bp, Homo sapiens
tctccttgttctgattctctccccatctacaacaactccactccccaaag

SEQ ID NO: 7004 - DNA, 50 bp, Homo sapiens
cacctaaccaagcgggttgggctgatgaccgatgaccgtaagcagtaagg

SEQ ID NO: 7005 - DNA, 50 bp, Homo sapiens
acctcttctttagcaacactaaccactccacactggggaaattatactct

SEQ ID NO: 7006 - DNA, 50 bp, Homo sapiens
actaccgcacaacagaacacatgaccaggtgagtgcagacacgacatcag

SEQ ID NO: 7007 - DNA, 50 bp, Homo sapiens
cagttttactcctggtcatctcttgtgagtgtggattcttctctgcccct

SEQ ID NO: 7008 - DNA, 50 bp, Homo sapiens
ttttattttggctgaagtttgggtatggctgcttgttggcctctgctggg

SEQ ID NO: 7009 - DNA, 50 bp, Homo sapiens
acagcttataaagcactttctcatgcacttcttctcgccgtatttgcaca

SEQ ID NO: 7010 - DNA, 50 bp, Homo sapiens
ggggctcaaacctgtgacttactgctaactaacatcaaaggaaaagctgg

SEQ ID NO: 7011 - DNA, 50 bp, Homo sapiens
atgatcattgatagatattctaagagcatgcaggaatgaggatgcgtgcc

SEQ ID NO: 7012 - DNA, 50 bp, Homo sapiens
gacaacaaacctgcttgcttggttacccacagcgcactgagtatagaagt

SEQ ID NO: 7013 - DNA, 50 bp, Homo sapiens
tcttcaattattcatgctctaaggcagtgtctgtcttcccaccatcccgc

SEQ ID NO: 7014 - DNA, 52 bp, Homo sapiens
tgagtatttttaaaatcccctgtttggatgcttccagctaaatagtctacct

SEQ ID NO: 7015 - DNA, 52 bp, Homo sapiens
tgggtttactcagatcttctccttcttaagtgagagttttaacctacatttt

SEQ ID NO: 7016 - DNA, 50 bp, Homo sapiens
gtccagagctagaagaaccaagtcttcctttcttcattcattgttcaggt

SEQ ID NO: 7017 - DNA, 50 bp, Homo sapiens
cttcttcttaggatctggagggaggggagtgttagagcttgtgagccatg

SEQ ID NO: 7018 - DNA, 50 bp, Homo sapiens
ctgaacgaaccagttcttttggactaccagttcttgaagtgaagctcaga

SEQ ID NO: 7019 - DNA, 50 bp, Homo sapiens
aacaaaagcactgacaagctcatatgaacaggctaaaaagtgagtgaagt

SEQ ID NO: 7020 - DNA, 50 bp, Homo sapiens
ttctctttctatatctagctaaattgcctgtgcgcctcccatcctcctca

SEQ ID NO: 7021 - DNA, 50 bp, Homo sapiens
acacacttgataaattagaccgatgcaaaccgcaagaatccaaatcagct

SEQ ID NO: 7022 - DNA, 50 bp, Homo sapiens
atagtaggtgagccagtagtgtgaatgcttgtcaagcttccaaggatgga

SEQ ID NO: 7023 - DNA, 50 bp, Homo sapiens
aaccaccacccagcttcctggtacaagcagggactctggctacagtgcta

SEQ ID NO: 7024 - DNA, 50 bp, Homo sapiens
tttcctcccctccctccccaatccacaaaacacgtaattctgactatcca

SEQ ID NO: 7025 - DNA, 50 bp, Homo sapiens
caacattcacaaaactggtccccgaattagtgagaaggttccaggagtgc

SEQ ID NO: 7026 - DNA, 50 bp, Homo sapiens
gagagattatagcacagtctcccagggctcagtcaggtcatccgcagcaa

SEQ ID NO: 7027 - DNA, 50 bp, Homo sapiens
ttcaatgctttgtcctcccctcgcagatgtttagaacagatcctccttct

SEQ ID NO: 7028 - DNA, 50 bp, Homo sapiens
tccctctctcagggctgggaaagaaaggttcatcttcactcagatgcaag

SEQ ID NO: 7029 - DNA, 50 bp, Homo sapiens
ttctgttggtctgccagctcatccattcatccatcacctgccagctagac

SEQ ID NO: 7030 - DNA, 50 bp, Homo sapiens
acacagttttggctcccttattttccccgtactcgaaacatttccatgca

SEQ ID NO: 7031 - DNA, 50 bp, Homo sapiens
accaaatcgcaaaaatacagaatgcctgtaaattgagtcacaccttaaaa

SEQ ID NO: 7032 - DNA, 50 bp, Homo sapiens
gagtccataaatctgcatttcatgtagttgtaagactttctcccaaaggt

SEQ ID NO: 7033 - DNA, 50 bp, Homo sapiens
tccatttgagttttcttcccatctctcacagttgattgttctgtcccttc

SEQ ID NO: 7034 - DNA, 50 bp, Homo sapiens
aaaattcagccctcctggattcacgtgcccaatgaaagtccccaaactag

SEQ ID NO: 7035 - DNA, 50 bp, Homo sapiens
tttaacaggaaaagcccaaaattatttttatgctgtctacaatctgggcc

SEQ ID NO: 7036 - DNA, 50 bp, Homo sapiens
agttgcactggttgttcttggctgcggtgcttctcacacaagaagcccag

SEQ ID NO: 7037 - DNA, 50 bp, Homo sapiens
tttcctttttcccttgtcccttggcttcccccatcaccgaatcccccttc

SEQ ID NO: 7038 - DNA, 50 bp, Homo sapiens
ctcccacgcctggccgtagtccagagcttcttctttttcatggttgggtt

SEQ ID NO: 7039 - DNA, 50 bp, Homo sapiens
gccagtgtacgttgccaggcatttcatgtaagagaaaactcaaatagcca

SEQ ID NO: 7040 - DNA, 50 bp, Homo sapiens
ccgtcttcttttgggtgtttcctcctagtttcggcggaaatcagagttca

SEQ ID NO: 7041 - DNA, 50 bp, Homo sapiens
atgaaccctcacctgctctgcagtgcagttttgattttagtcccagcaaa

SEQ ID NO: 7042 - DNA, 58 bp, Homo sapiens
agatatagatggtaaaatgtgatgcaatgtaaaaaaatggtaatacacacactctcca

SEQ ID NO: 7043 - DNA, 50 bp, Homo sapiens
tgagtgggcttctcttatggtacagtctcttctctatgaggggcttcaaa

SEQ ID NO: 7044 - DNA, 50 bp, Homo sapiens
tgggcttccaaatggtacaatggagtaatcaagctcatggactgagagtt

SEQ ID NO: 7045 - DNA, 50 bp, Homo sapiens
cttgaagctacttgtccctttctgtgccagaccacttaatggctacccac

SEQ ID NO: 7046 - DNA, 50 bp, Homo sapiens
ttcccagggcgctccatctacagccttactgtgactccactcagcaccag

SEQ ID NO: 7047 - DNA, 50 bp, Homo sapiens
attccccctaagctcctgtcccccgccatgcacgactggtcacatcaaaa

SEQ ID NO: 7048 - DNA, 50 bp, Homo sapiens
aagacacacccctcctgtttaataaaagttgtcccctcgacatgcataat

SEQ ID NO: 7049 - DNA, 50 bp, Homo sapiens
cctggttacaataatgaaactgtcgtggagtaaagagggaaacatgacca

SEQ ID NO: 7050 - DNA, 50 bp, Homo sapiens
agaacccacacactgggagacaataactgccattcatataaccaacagaa

SEQ ID NO: 7051 - DNA, 50 bp, Homo sapiens
cgccactgcttaaagattacagacaattcccaggtaaagttgccaggact

SEQ ID NO: 7052 - DNA, 50 bp, Homo sapiens
acaatgatgtttgaaacgcactctgaatctgtgaaagctagataagtcct

SEQ ID NO: 7053 - DNA, 50 bp, Homo sapiens
gccttcctcctcctccctcttgggcctatgtcctagataagcctgttaaa

SEQ ID NO: 7054 - DNA, 50 bp, Homo sapiens
tgtcaagatgacagatcttaatccagagtggaggctcgttcggcctggag

SEQ ID NO: 7055 - DNA, 50 bp, Homo sapiens
tttatgtttcagcctctttctctcccgttgagtcctgccacaagtcctgc

SEQ ID NO: 7056 - DNA, 50 bp, Homo sapiens
attgtccaggtgacttgacacttgcctaccggaaaagttgggatgttctt

SEQ ID NO: 7057 - DNA, 50 bp, Homo sapiens
taaaatatgccctaatttaaagggcgcagggtcccacaacaagccacaga

SEQ ID NO: 7058 - DNA, 50 bp, Homo sapiens
aaatctcttctcacgttctgtttgtcatttaatcaccaggtttttagcgc

SEQ ID NO: 7059 - DNA, 50 bp, Homo sapiens
gctactgatgggtggccctttattcttgtctttatttgttgtgtgcagga

SEQ ID NO: 7060 - DNA, 50 bp, Homo sapiens
aaaaattggtagctgcccccatgtggtatgatgtttaatttgaacaacat

SEQ ID NO: 7061 - DNA, 50 bp, Homo sapiens
acccggcacgtctcctcaaccccttaattcttttccagcttttcatatta

SEQ ID NO: 7062 - DNA, 50 bp, Homo sapiens
ctcaagagggcatagacattccacacgaggactgcattcgtcagggtaac

SEQ ID NO: 7063 - DNA, 50 bp, Homo sapiens
aacaaatacccaattaactgtattcccctttcccctatgactgctggtgt

SEQ ID NO: 7064 - DNA, 50 bp, Homo sapiens
ccgttgtccgaaagcttgcttccaactaaagaccagagatgggagggagt

SEQ ID NO: 7065 - DNA, 50 bp, Homo sapiens
tttagcccaaagaagactttcgcataaattctgccgtaacccttgttgga

SEQ ID NO: 7066 - DNA, 50 bp, Homo sapiens
caaagcagcaaatacagagcacacaacaatccttggcctgagcagaacaa

SEQ ID NO: 7067 - DNA, 50 bp, Homo sapiens
atatgaagatggattggatgaggactgacaaaacgaagacatgccgggcc

SEQ ID NO: 7068 - DNA, 50 bp, Homo sapiens
atgcctagtcagtcagtatttcttcttgctgcaggtgtctaaaaacccac

SEQ ID NO: 7069 - DNA, 50 bp, Homo sapiens
ccttcgcattcccccatccatgctccaagataatagatttttctttaaaa

SEQ ID NO: 7070 - DNA, 50 bp, Homo sapiens
ggggaacactttggtttgaaagcacagagcagtttgccatgtttcttctg

SEQ ID NO: 7071 - DNA, 50 bp, Homo sapiens
actgaatggtcgaaatcacatatgcaccacacatactgatcttaagtaac

SEQ ID NO: 7072 - DNA, 50 bp, Homo sapiens
cgaggtacagcaaagcgacccttggtgtcatagatcagacggaaattctc

SEQ ID NO: 7073 - DNA, 50 bp, Homo sapiens
tacagaagagcagagaccaaccttctcaaagttggtgagtattaacccag

SEQ ID NO: 7074 - DNA, 50 bp, Homo sapiens
ccagatttgctgatgtgttaggtagttgtggcacactcacctgtctttcc

SEQ ID NO: 7075 - DNA, 50 bp, Homo sapiens; identical to SEQ ID NO: 379

SEQ ID NO: 7076 - DNA, 50 bp, Homo sapiens
ttgaacattcgcaaagtaacatctctcactcccaacaccacagcttatcg

SEQ ID NO: 7077 - DNA, 50 bp, Homo sapiens
agtaaccaccaaagcatagttttagaagggctttcgcaaacctagccttt

SEQ ID NO: 7078 - DNA, 50 bp, Homo sapiens
tcttgcttgttcttctcgtttttgttttatcttccgcccggcagggtcag

SEQ ID NO: 7079 - DNA, 50 bp, Homo sapiens
gctctgaaacccctggaactcttgagcctaaaatgtatttttacaatctt

SEQ ID NO: 7080 - DNA, 50 bp, Homo sapiens
atctttgatgtgaagccctttaaaaataaacgtgaaggtgccagcttgca

SEQ ID NO: 7081 - DNA, 50 bp, Homo sapiens
acccagcctgatgttcatcttttccccctcttcattttccttctttgttt

SEQ ID NO: 7082 - DNA, 50 bp, Homo sapiens
agaaagactaacaccagaaatcatgctgcaacaccagaacatcctttgga

SEQ ID NO: 7083 - DNA, 50 bp, Homo sapiens
tcacaaaatatggctcaaggagtataaatcccctctcacgcacccacaaa

SEQ ID NO: 7084 - DNA, 50 bp, Homo sapiens
actaaccaaccaatgagaatactacttacctccacccatgctgtgaaccc

SEQ ID NO: 7085 - DNA, 50 bp, Homo sapiens
tgaccgcctcaaagaccaaaaggactctactccatattcttctcactgtc

SEQ ID NO: 7086 - DNA, 50 bp, Homo sapiens
gaatgaccacctgacgcattcagagctcaccttcttgttcttcagctgtt

SEQ ID NO: 7087 - DNA, 50 bp, Homo sapiens
ttggtagaaaccacccaaccataaaattcccaagcctgtactggtcagcc

SEQ ID NO: 7088 - DNA, 50 bp, Homo sapiens
cataagttgggtgaagaaatggtggttttaatcagtaatatagctccccc

SEQ ID NO: 7089 - DNA, 50 bp, Homo sapiens
ttctcatctcaatatcccccagagccccagtacctcataatacaagactt

SEQ ID NO: 7090 - DNA, 50 bp, Homo sapiens; identical to SEQ ID NO: 383

SEQ ID NO: 7091 - DNA, 50 bp, Homo sapiens
tacccaaagtctattcgtaagtgcatcttttctattagactggaagctcc

SEQ ID NO: 7092 - DNA, 50 bp, Homo sapiens
gatggttcagcaactgaggagctcagggtgacgggtccacagagcacaga

SEQ ID NO: 7093 - DNA, 50 bp, Homo sapiens
agaaattagaagatgactaccatttgctaaagtctatccacatgccagca

SEQ ID NO: 7094 - DNA, 50 bp, Homo sapiens
ccccctcgaccccctcacaccctttccagagaggccttaagattcccatt

SEQ ID NO: 7095 - DNA, 50 bp, Homo sapiens
tgtaaggtttcataaatttagagaccctagccagtcagtgacaatatgca

SEQ ID NO: 7096 - DNA, 52 bp, Homo sapiens
gagttgcttattccagtctctctaagatatatctccctttttagttgctgac

SEQ ID NO: 7097 - DNA, 50 bp, Homo sapiens
tggtgtaatgaacatgccgtattgcctttatggccagtttgagtccttcc

SEQ ID NO: 7098 - DNA, 50 bp, Homo sapiens
agggaaccccaaagagttaaaaccaggaccactatttcatagtcaacaaa

SEQ ID NO: 7099 - DNA, 50 bp, Homo sapiens
gtggtaaatgagagcattacagaccacccacatcagcctaaaatataatt

SEQ ID NO: 7100 - DNA, 50 bp, Homo sapiens
ccaccaaacccaacaggccgggacaaatgcaataccatacagaaacacag

SEQ ID NO: 7101 - DNA, 50 bp, Homo sapiens
ggccaaactttcttactctgccatttgttcaatgtcctaatgagcatgaa

SEQ ID NO: 7102 - DNA, 50 bp, Homo sapiens
atcaatcgggccaatccgaagtcagcaatcttgcatatgagtccattccc

SEQ ID NO: 7103 - DNA, 50 bp, Homo sapiens
tatttttaacaaaatcacacggaaggatttccttcccgtcccatgtgttg

SEQ ID NO: 7104 - DNA, 50 bp, Homo sapiens
cagatagtggtatttgggtgctgggcttgtctgacctgaggaggtggctg

SEQ ID NO: 7105 - DNA, 50 bp, Homo sapiens
aactccatagagaaagactacgaatttcgctgggaggtaatagggaagcc

SEQ ID NO: 7106 - DNA, 50 bp, Homo sapiens
gcatttaggaaagacaggtgagtgtgccacaactacctaacacatcagca

SEQ ID NO: 7107 - DNA, 50 bp, Homo sapiens
ttactttgtcttctctcaccatcctaaaacgttgttttgctgagcatgaa

SEQ ID NO: 7108 - DNA, 50 bp, Homo sapiens
ccccagacgaaaataccaaatgcatggagagctcccgtgagtggttaata

SEQ ID NO: 7109 - DNA, 50 bp, Homo sapiens
gcctaagtttccagaagactttgacgatggagagcatgcaaagcaggtaa

SEQ ID NO: 7110 - DNA, 50 bp, Homo sapiens
ttttgcagttcaaggattggtgggaaacgtttgtatgtgttggggtgggg

SEQ ID NO: 7111 - DNA, 50 bp, Homo sapiens
aatagatttccatttcttccttcgagttagttgggtattgggaccttgaa

SEQ ID NO: 7112 - DNA, 50 bp, Homo sapiens
cgacggtgttctggagtttcgatgagacatgtaagtaagagttctgtgca

SEQ ID NO: 7113 - DNA, 50 bp, Homo sapiens
atattcagcagtggctgtgaaattggatttgaattaccgggatacatgca

SEQ ID NO: 7114 - DNA, 50 bp, Homo sapiens
actggttttcattctagtgtcccccacccgtctagtttcattttcctgta

SEQ ID NO: 7115 - DNA, 50 bp, Homo sapiens
ttgggagtcaccaggttaaagcaaagcctcagtcactgaaagcagaaact

SEQ ID NO: 7116 - DNA, 50 bp, Homo sapiens
tcctgtgctccagaattagtgattgctttggtgcttaacttgaagtggga

SEQ ID NO: 7117 - DNA, 50 bp, Homo sapiens
catctgctctgcttcctcacacactagaaacaccactgcccccatccatg

SEQ ID NO: 7118 - DNA, 50 bp, Homo sapiens
tctgtgatttatagactgttttcaggaaacgatcttcccatctgtggtga

SEQ ID NO: 7119 - DNA, 50 bp, Homo sapiens
tcatttcaggtctaataaacacactaacctcggcagcactggagcgtctg

SEQ ID NO: 7120 - DNA, 50 bp, Homo sapiens
agcttaggatatctattagtgttcactgttcgggcaagaggcctaaaggg

SEQ ID NO: 7121 - DNA, 50 bp, Homo sapiens
tgggaacacactggcccattatatagagaaaaataaaacatgatccccat

SEQ ID NO: 7122 - DNA, 50 bp, Homo sapiens
ttgcttgatttcccaaaccactacctgaaggtggcttatggtctacagct

SEQ ID NO: 7123 - DNA, 50 bp, Homo sapiens
ttccaccacttcaagactgggggcaggtagagaagacaagcataagtaca

SEQ ID NO: 7124 - DNA, 50 bp, Homo sapiens
ttcttctctgcccctaacagaatgttcttctcttgcttcccacaccctcc

SEQ ID NO: 7125 - DNA, 50 bp, Homo sapiens
cagcacatcttctggtttacaagttgggtaactatgaaagctggagatgc

SEQ ID NO: 7126 - DNA, 50 bp, Homo sapiens
tatctaaattctacctttagcatccaactagctaccgtctggcactggcc

SEQ ID NO: 7127 - DNA, 50 bp, Homo sapiens
tccaatgctcaagtcactctgagtctttgctggtgtcaacctacaatgcc

SEQ ID NO: 7128 - DNA, 50 bp, Homo sapiens
acctcactatagtagccattaggtaaagatgggccatatccaaatgggct

SEQ ID NO: 7129 - DNA, 50 bp, Homo sapiens
aagaactattcctttgagaatctttcctactgggagttactgctgtgatt

SEQ ID NO: 7130 - DNA, 50 bp, Homo sapiens
tctgtgtgaacatacatacaggactttgattctacctgtgcctgaccatt

SEQ ID NO: 7131 - DNA, 50 bp, Homo sapiens
gtggagctgttggccttgctggatgcgggcactctctacaccttcaggta

SEQ ID NO: 7132 - DNA, 50 bp, Homo sapiens
tgtcagtggctctcactttgtttgaaattgttgctttgggaaaaacacag

SEQ ID NO: 7133 - DNA, 50 bp, Homo sapiens
gatgcagtgggttaggggttgggggtacagactgacttgagctcggagtc

SEQ ID NO: 7134 - DNA, 50 bp, Homo sapiens
tcaggcactcagtaaaggcaagacttgagtgatacataaagtcagttaca

SEQ ID NO: 7135 - DNA, 50 bp, Homo sapiens
ccttgggctgagtttgctggtcctgaagattacagttttggttagagaga

SEQ ID NO: 7136 - DNA, 50 bp, Homo sapiens
acagcaaacaaagtgttccaatcctctattaacccatttaaccaagagtt

SEQ ID NO: 7137 - DNA, 50 bp, Homo sapiens; identical to SEQ ID NO: 6930

SEQ ID NO: 7138 - DNA, 50 bp, Homo sapiens
aagtgtgattagaagcagctggaagtagcagaggaggtggaagttagtcc

SEQ ID NO: 7139 - DNA, 50 bp, Homo sapiens
caggagtaaaacagagctggttgtgtgatacctatgctgggtggaagact

SEQ ID NO: 7140 - DNA, 50 bp, Homo sapiens
ggtgactatcttaccggctcccagtaaactctgaacaatgtaccagctaa

SEQ ID NO: 7141 - DNA, 50 bp, Homo sapiens
gcttgaagatgtctcaacagaaaatcaccgacatgaggaagcatcacgct

SEQ ID NO: 7142 - DNA, 56 bp, Homo sapiens
aggaacatggctgcagcatataaaaagaattgaattccatacttttgttaaccctg

SEQ ID NO: 7143 - DNA, 50 bp, Homo sapiens
ggtgctgccataggtgccagtaatgaccgtttatgcggaaatcaattaca

SEQ ID NO: 7144 - DNA, 50 bp, Homo sapiens
tgaagtactataggactcaatgggaccagtagcagctccaagtggatcac

SEQ ID NO: 7145 - DNA, 50 bp, Homo sapiens
acacgggacctcctttgatctttctgagaattaatagagatttcatggca

SEQ ID NO: 7146 - DNA, 50 bp, Homo sapiens
ccaaaaggagaaagatgactagggtcacacttgaggatttgccaggtggg

SEQ ID NO: 7147 - DNA, 50 bp, Homo sapiens
gcatcttctttgaagacgggaactgtacttcaggttcttttctgtttagc

SEQ ID NO: 7148 - DNA, 50 bp, Homo sapiens
ggctcatttggttttaaagtctcttctatgccatcccaggggaggaggat

SEQ ID NO: 7149 - DNA, 50 bp, Homo sapiens
gactgtggacacctctcactgtgtcttcttggcaggcagagcttactgac

SEQ ID NO: 7150 - DNA, 50 bp, Homo sapiens
gcagggtgcagagcttcacagcaggtaggaagaagtaactaagtggaaac

SEQ ID NO: 7151 - DNA, 50 bp, Homo sapiens
cagctaaagccgtaggtcattgtgactgtccctgggatgtggattactct

SEQ ID NO: 7152 - DNA, 50 bp, Homo sapiens
ccagaatgcagcctacagaccaaatatcaatggacttggtgtagccctgc

SEQ ID NO: 7153 - DNA, 50 bp, Homo sapiens
tttaaaccaggtctggaaaaaggaaggagaggagggcattttagagaaga

SEQ ID NO: 7154 - DNA, 50 bp, Homo sapiens
gtggcttcgtaaaatagaagagcagtcactgtggaactaccaaatggcga

SEQ ID NO: 7155 - DNA, 50 bp, Homo sapiens
cacaccacagctggctgggagcagaggctgctggtctcatagtaatctac

SEQ ID NO: 7156 - DNA, 50 bp, Homo sapiens
tggagaaaatgagagacagacagtgagtgagaaagtcagcgaaaaggaaa

SEQ ID NO: 7157 - DNA, 50 bp, Homo sapiens
acctactgttgagattattcccctgtctccacactgccagaaacttacca

SEQ ID NO: 7158 - DNA, 50 bp, Homo sapiens
ccaaatgatactaggattaagccccaaagcaaagtcaagcaccaccatgg

SEQ ID NO: 7159 - DNA, 50 bp, Homo sapiens
tcccagagcaacaactaagtctcaactaatggacaaccaacacccactga

SEQ ID NO: 7160 - DNA, 50 bp, Homo sapiens
ccacagaatgggcatgtagtattgagatttgaatcatctgctgtccagcc

SEQ ID NO: 7161 - DNA, 50 bp, Homo sapiens
acctcatccggctgctcaagtgcaagcgtgacagcttccccaacttcctg

SEQ ID NO: 7162 - DNA, 50 bp, Homo sapiens
gacctggtgctgtcgccctggcatcttaataaaacctgcttatacttccc

SEQ ID NO: 7163 - DNA, 50 bp, Homo sapiens
gcataaggaagacttgctcccctgtcctatgaaagagaatagttttggag

SEQ ID NO: 7164 - DNA, 50 bp, Homo sapiens
gggactcatctttccctccttggtgattccgcagtgagagagtggctggg

SEQ ID NO: 7165 - DNA, 50 bp, Homo sapiens
agactggatcgcacacctttgcaacagatgtgttctgattctctgaacct

SEQ ID NO: 7166 - DNA, 50 bp, Homo sapiens
aagcaaataccttttacaagtgaaaggaagaatttttcttctgccgtcaa

SEQ ID NO: 7167 - DNA, 50 bp, Homo sapiens
gcaacaaatgcttctattccatagctacggcattgctcagtaagttgagg

SEQ ID NO: 7168 - DNA, 50 bp, Homo sapiens
tccgtgtagaggttacagccttttatgctgttgagctcccaggtaccaaa

SEQ ID NO: 7169 - DNA, 50 bp, Homo sapiens
gcccacttggatttatagtatagcccttcctcgactcccaccagacttgc

SEQ ID NO: 7170 - DNA, 50 bp, Homo sapiens
aagagctcctgagccccctgcccccagagcaataaagtcagctggctttc

SEQ ID NO: 7171 - DNA, 50 bp, Homo sapiens
gctcaacatggaaagaaggtacagaaagtgatgtgttcaaaacattagca

SEQ ID NO: 7172 - DNA, 50 bp, Homo sapiens
ttatataccctggtcccatctttctagggcctggatctgcttatagagca

SEQ ID NO: 7173 - DNA, 50 bp, Homo sapiens
gtttactccgtccctatcactggtgtggctgtgggcaaaccacttattgc

SEQ ID NO: 7174 - DNA, 50 bp, Homo sapiens
gaactgaagcctgcacagtgtccaccctgttcccactcccatctttcttc

SEQ ID NO: 7175 - DNA, 50 bp, Homo sapiens
gaagaccaagagagacaacagacgcagcaaacagccgaagcaccagacaa

SEQ ID NO: 7176 - DNA, 50 bp, Homo sapiens
aattcagaaaattgttgggaggacagcccttttgtgaaccttgtttgggg

SEQ ID NO: 7177 - DNA, 50 bp, Homo sapiens
tttacccagctctgaaggtcattgttcttgcctgtgtttgaataaaatca

SEQ ID NO: 7178 - DNA, 50 bp, Homo sapiens
gtctctgatgctttgtatcattcttgagcaatcgctcggtccgtggacaa

SEQ ID NO: 7179 - DNA, 50 bp, Homo sapiens
ggtaagcccctgagcctgggacctacatgtggtttgcgtaataaaacatt

SEQ ID NO: 7180 - DNA, 50 bp, Homo sapiens
tctggctctgaccggttgatggccttgagcgaatgaaatcatgaaattga

SEQ ID NO: 7181 - DNA, 50 bp, Homo sapiens
tgccctacatagcaattttctgtggcactgagaaaccatgtatgaccaca

SEQ ID NO: 7182 - DNA, 50 bp, Homo sapiens
gcagtgtactgtgtgcaataccaagggcatagctccctgtaatttgggaa

SEQ ID NO: 7183 - DNA, 50 bp, Homo sapiens
ctgagactagggtcccagcacagcccagaaacctttggccacaagaagtg

SEQ ID NO: 7184 - DNA, 50 bp, Homo sapiens
tcgccttccatggtttttaaatgcagtaaataacatttctggatgagact

SEQ ID NO: 7185 - DNA, 50 bp, Homo sapiens
gctttacccccgcaggacatacacaggagcctttgatctcattaaagaga

SEQ ID NO: 7186 - DNA, 50 bp, Homo sapiens
ggaatgtacctctccccaacactgttttgttagcgagcaccttttgacca

SEQ ID NO: 7187 - DNA, 50 bp, Homo sapiens
actcgctcagaagagggaactaagcatttttggcaaccaatgggcagata

SEQ ID NO: 7188 - DNA, 50 bp, Homo sapiens
agctgtgtgaacctctcttattggaaattctgttccgtgtttgtgtaggt

SEQ ID NO: 7189 - DNA, 50 bp, Homo sapiens
agtcccatacatttggaccatggcagctaattttgtaacttaagcattca

SEQ ID NO: 7190 - DNA, 50 bp, Homo sapiens
ctgcccccttcctggacttcgtgccttactgagtctctaagactttttct

SEQ ID NO: 7191 - DNA, 50 bp, Homo sapiens
ggataacatttctcatgaacccactgcccctctgcattttcctcactggt

SEQ ID NO: 7192 - DNA, 50 bp, Homo sapiens
cgcttaagaacattgcctctgggtgtcatgtggaccagacttctgaatag

SEQ ID NO: 7193 - DNA, 50 bp, Homo sapiens
gggttcaatcccttcagctcaggcggaccatttagatttaaattccactt

SEQ ID NO: 7194 - DNA, 50 bp, Homo sapiens
gctcctgccagggctgttaccgttgttttcttgaatcactcacaatgaga

SEQ ID NO: 7195 - DNA, 50 bp, Homo sapiens
aatctggcgaaaccttcgtttgagggactgatgtgagtgtatgtccacct

SEQ ID NO: 7196 - DNA, 50 bp, Homo sapiens
gactatgggctctgaagggggcaggagtcagcaataaagctatgtctgat

SEQ ID NO: 7197 - DNA, 50 bp, Homo sapiens
agggaggggacagatggggagcttttcttacctattcaaggaatacgtgc

SEQ ID NO: 7198 - DNA, 50 bp, Homo sapiens
accttctgaaagctcacagtacacattagtatgtataactggctttacca

SEQ ID NO: 7199 - DNA, 50 bp, Homo sapiens
tttaagggagtcaggaatagatgtatgaacagtcgtgtcactggatgcct

SEQ ID NO: 7200 - DNA, 50 bp, Homo sapiens
cccaccttccacctcttagcactggtgaccccaaaaatgaaaccatcaat

SEQ ID NO: 7201 - DNA, 50 bp, Homo sapiens
agaccagcagtgtttaaatctaaatacgttgtgagtctgttatctgtcct

SEQ ID NO: 7202 - DNA, 50 bp, Homo sapiens
acctcgacctcagagcctcccacccagaagatcctgcttccgtggttgag

SEQ ID NO: 7203 - DNA, 50 bp, Homo sapiens
gggcagtgggtcccagattggctcacactgagaatgtaagaactacaaac

SEQ ID NO: 7204 - DNA, 50 bp, Homo sapiens
tggccttaagttttctaattcaagcgggtttttggaaaaatttatggtct

SEQ ID NO: 7205 - DNA, 50 bp, Homo sapiens
tgcagagttataagccccaaacaggtcatgctccaataaaaatgattcta

SEQ ID NO: 7206 - DNA, 50 bp, Homo sapiens
ccaaacaatgatgtggattcttttgcacagaaatatttaaggtgggatgg

SEQ ID NO: 7207 - DNA, 50 bp, Homo sapiens
acaaaagtcaactgttgtctcttttcaaaccaaattgggagaattgttgc

SEQ ID NO: 7208 - DNA, 50 bp, Homo sapiens
gctggggactctagcctctgtgttcataaagacattaagaagtggatgga

SEQ ID NO: 7209 - DNA, 50 bp, Homo sapiens
ggagaatgacacatcaagctgctaacaattgggggaaggggaaggaagaa

SEQ ID NO: 7210 - DNA, 50 bp, Homo sapiens
acctgggtttaatacagctcacatcactgaatgttacacatgagtttaaa

SEQ ID NO: 7211 - DNA, 50 bp, Homo sapiens
cttaaggacgcctttgcctggcccctttattacagcccaacacggtaggc

SEQ ID NO: 7212 - DNA, 50 bp, Homo sapiens
tccatcagtgccatttcctgtagaactaaaggctgttccaagaatgtggg

SEQ ID NO: 7213 - DNA, 50 bp, Homo sapiens
atctgtaaagcactcagaaggcagccatccctagatgttggtttcatgta

SEQ ID NO: 7214 - DNA, 50 bp, Homo sapiens
tggttagattgttttcacttggtgatcatgtcttttccatgtgtacctgt

SEQ ID NO: 7215 - DNA, 50 bp, Homo sapiens
catgtcccttgaaacatgatagttacatacacagttttctctccacacat

SEQ ID NO: 7216 - DNA, 50 bp, Homo sapiens
aggtttcacatgaacctgttctaggctgtggacattggtgtggagaggtt

SEQ ID NO: 7217 - DNA, 50 bp, Homo sapiens
gacacttggggtccacaatcccaggtccatactctaggttttggatacca

SEQ ID NO: 7218 - DNA, 50 bp, Homo sapiens
agaaatgatttgcagctgagtgaatcaggaagtgacagtgatgactgaag

SEQ ID NO: 7219 - DNA, 50 bp, Homo sapiens
tcctgagagatggacaatgaaatatcagttggtggatatgtgtgatagct

SEQ ID NO: 7220 - DNA, 50 bp, Homo sapiens
ctttcagggcaggcagctgtgcatgttctctcaactaaaggtcttgtgag

SEQ ID NO: 7221 - DNA, 50 bp, Homo sapiens
gctggacacacggtgagattttctcgtatgtaaataaaaggcaatttggt

SEQ ID NO: 7222 - DNA, 50 bp, Homo sapiens
ctcaacgaaaggctcacactaacaggggaggattacagcaccacaatact

SEQ ID NO: 7223 - DNA, 50 bp, Homo sapiens
ccacactgaacccaattacacacagcgggagaacgcagtaaacagctttc

SEQ ID NO: 7224 - DNA, 50 bp, Homo sapiens
aggccctggaaaattttgtgcttccaacgtggccttcaattcttgctttt

SEQ ID NO: 7225 - DNA, 50 bp, Homo sapiens
tattaagcttgcccaggctcctgttcatgaaggttcccccagcggtggcc

SEQ ID NO: 7226 - DNA, 50 bp, Homo sapiens
gctataccactgactgtattgaaaaccaaagtattaagaggggaaacgcc

SEQ ID NO: 7227 - DNA, 50 bp, Homo sapiens
tcggggtcagttaagcctcagtattcttagcttttgttgattttggcact

SEQ ID NO: 7228 - DNA, 50 bp, Homo sapiens
atggtgcaaaccctggaacagtatgaattctgctacaaagtggtacaaga

SEQ ID NO: 7229 - DNA, 50 bp, Homo sapiens
agaagcagcgagtgcatgggctaattatcatcaatctttatgtatttgtt

SEQ ID NO: 7230 - DNA, 50 bp, Homo sapiens
ggaaatgttgctgtgggggattcattgtaactctccttgtgaactgctca

SEQ ID NO: 7231 - DNA, 50 bp, Homo sapiens
atgccaaattcctgacacgtggcgtttgaaaataccatggaacgtttcca

SEQ ID NO: 7232 - DNA, 50 bp, Homo sapiens
acattctgactccatctgcggcctcattaaggtgatagaaacatactagg

SEQ ID NO: 7233 - DNA, 50 bp, Homo sapiens
atgataatgttggcatctgtgataaactatcaatgaggctcccatcatgc

SEQ ID NO: 7234 - DNA, 50 bp, Homo sapiens
agagtcacatgtagaaaagcctccagtattaagctcctgaattcattcct

SEQ ID NO: 7235 - DNA, 50 bp, Homo sapiens
atggcaacaatgctgacagcaagcagtagatcctctgattccaattacca

SEQ ID NO: 7236 - DNA, 50 bp, Homo sapiens
gggaaccctcattaattagacaagaacaccaaggctatgaccacagcagc

SEQ ID NO: 7237 - DNA, 50 bp, Homo sapiens
ggctcaccagagtacccagaagaatcagtatggaattagaggacagtggc

SEQ ID NO: 7238 - DNA, 50 bp, Homo sapiens
attccaggccctcagtctttggcaatggccaccctggtgttggcatattg

SEQ ID NO: 7239 - DNA, 50 bp, Homo sapiens
gcatacataaaggcaaagaatgacaaaaggcttaatccacctagaagaca

SEQ ID NO: 7240 - DNA, 50 bp, Homo sapiens
atatagtgggagacaaaacacaggaggcgggggatatcatgtagcagagc

SEQ ID NO: 7241 - DNA, 50 bp, Homo sapiens
tctaatgtgccttggatatgtgccaaatgatggaaaagaaacagtaaact

SEQ ID NO: 7242 - DNA, 50 bp, Homo sapiens
gcttggctcatctggggtttgctgggcttaacacccaataaagaactttg

SEQ ID NO: 7243 - DNA, 50 bp, Homo sapiens
ctgcggttttggaaccttacctctcctccttagcccaatatgctgtcttg

SEQ ID NO: 7244 - DNA, 50 bp, Homo sapiens
tccaggccattttgcagggactctgaagtgacctttagtagtaatagtct

SEQ ID NO: 7245 - DNA, 50 bp, Homo sapiens
tggcagccaggaactgagtatgacaatgttgtactaaagaaaggcccaaa

SEQ ID NO: 7246 - DNA, 50 bp, Homo sapiens
agagagagacatatcacgctgctgtcatgattttgtgtcaagatgatcca

SEQ ID NO: 7247 - DNA, 50 bp, Homo sapiens
cttctggggacctttcctacccccatcagcatcaataaaacctcctgtct

SEQ ID NO: 7248 - DNA, 50 bp, Homo sapiens
tagatgatttctagcaggcaggaagtcctgtgcggtgtcaccatgagcac

SEQ ID NO: 7249 - DNA, 50 bp, Homo sapiens
ccatggtctggggcttgaggaagatgagtttgttgatttaaataaagaat

SEQ ID NO: 7250 - DNA, 50 bp, Homo sapiens
aggtcaagggcttactatttctgggtcttttgctactaagttcacattag

SEQ ID NO: 7251 - DNA, 50 bp, Homo sapiens
tttctggggacctcttgaattacatgctgtaacatatgaagtgatgtggt

SEQ ID NO: 7252 - DNA, 50 bp, Homo sapiens
tggcacaaaacctcctcctcccaggcactcatttatattgctctgaaaga

SEQ ID NO: 7253 - DNA, 50 bp, Homo sapiens
tgaggtcactgccacttctcacatgctgcttaagggagcacaaataaagg

SEQ ID NO: 7254 - DNA, 50 bp, Homo sapiens
cacgctaccccctgccttgggaggtgtgtggaataaattatttttgttaa

SEQ ID NO: 7255 - DNA, 50 bp, Homo sapiens
aatgcagagaatggaaagtagcgcatccctgaggctggactccagatctg

SEQ ID NO: 7256 - DNA, 50 bp, Homo sapiens
gtggcacaccactccttccagcagtagtcgctttactgttacctgtttag

SEQ ID NO: 7257 - DNA, 50 bp, Homo sapiens
agcaacagtattctgcatggttcactgcttaagaaaatgccttctggaat

SEQ ID NO: 7258 - DNA, 50 bp, Homo sapiens
aaacatgtccctggagagtagcctgctcccacactgtcactggatgtcat

SEQ ID NO: 7259 - DNA, 50 bp, Homo sapiens
cagttgcagcctcttgacctcggataacaataagagagctcatctcattt

SEQ ID NO: 7260 - DNA, 50 bp, Homo sapiens
tgggcttggtcttccagttggcatttgcctgaagttgtattgaaacaatt

SEQ ID NO: 7261 - DNA, 50 bp, Homo sapiens
ttctgccgtgtgtatccccaacccttgacccaatgacaccaaacacagtg

SEQ ID NO: 7262 - DNA, 50 bp, Homo sapiens
tgtgtgcgacagggaggaagtttcaataaagcaacaacaagcttcaagga

SEQ ID NO: 7263 - DNA, 50 bp, Homo sapiens
ctccccttgggcggctgagagccccagctgacatggaaatacagttgttg

SEQ ID NO: 7264 - DNA, 50 bp, Homo sapiens
ctccaccacctgaccagagtgttctcttcagaggactggctcctttccca

SEQ ID NO: 7265 - DNA, 50 bp, Homo sapiens
ctctgccctcctgtcacccagtagagtaaataaacttccttggctcctaa

SEQ ID NO: 7266 - DNA, 50 bp, Homo sapiens
aaattccagccttgactttcttctgtgcacctgatgggagggtaatgtct

SEQ ID NO: 7267 - DNA, 50 bp, Homo sapiens
ctgtaggccagggtggaatgaagtcagctcctttttatagttgaaataca

SEQ ID NO: 7268 - DNA, 50 bp, Homo sapiens
ttggcgggccatcccaacaggtgatgaccccacaaggaagaggtactgtt

SEQ ID NO: 7269 - DNA, 50 bp, Homo sapiens
ggaagatggaaataaacctgcgtgtgggtggagtgttctcgtgccgaatt

SEQ ID NO: 7270 - DNA, 50 bp, Homo sapiens
agtgaggacaatgtggcttgctcctttttgaatctacagataatgcatgt

SEQ ID NO: 7271 - DNA, 50 bp, Homo sapiens
gagggtgggggagggaggtggagggagggaagggtttctctattaaaatg

SEQ ID NO: 7272 - DNA, 50 bp, Homo sapiens
tgctgactgtagctttggaagtttagctctgagaaccgtagatgatttca

SEQ ID NO: 7273 - DNA, 50 bp, Homo sapiens
gattgaggaaggtccgcacagcctgtctctgctcagttgcaataaacgtg

SEQ ID NO: 7274 - DNA, 50 bp, Homo sapiens
gattcttgtctggctaataaatcatcaccaactgccttctcctacaggga

SEQ ID NO: 7275 - DNA, 50 bp, Homo sapiens
agattcttagggcacgtttgttccccttggagggttttccacacggagtc

SEQ ID NO: 7276 - DNA, 50 bp, Homo sapiens
gccatactctggctgcctctttgccttcctaggggcattttctttaactt

SEQ ID NO: 7277 - DNA, 50 bp, Homo sapiens
tgcctcttatctacttgagagcaacatgtcttttcaatcatgggattgac

SEQ ID NO: 7278 - DNA, 50 bp, Homo sapiens
tggacctgtgacattctggactatttctgtgtttatttgtggccgagtgt

SEQ ID NO: 7279 - DNA, 50 bp, Homo sapiens
tgaaggtgtctgtgacctctttgatgtgcctgttctcaacctctgactga

SEQ ID NO: 7280 - DNA, 50 bp, Homo sapiens
cctggagtccctgaataaagataagaagcatcactgaagataatacctgg

SEQ ID NO: 7281 - DNA, 50 bp, Homo sapiens
ttgtcccgaagatttgcgcctttagtgccttttgaggggttcccatcatc

SEQ ID NO: 7282 - DNA, 50 bp, Homo sapiens
ctgctaggctctgcccaccggccaccaacactcctgtaattccaataaag

SEQ ID NO: 7283 - DNA, 50 bp, Homo sapiens
ttaaaatactgtcattggttgggaggggattgcattaaatgattagtcca

SEQ ID NO: 7284 - DNA, 50 bp, Homo sapiens
ctcacacacgcaggcgacagtcagaacaaacaggaacaaagctacaacac

SEQ ID NO: 7285 - DNA, 50 bp, Homo sapiens
tgaatagtgtgcagactcacagataataaagctcagagcagctcccggca

SEQ ID NO: 7286 - DNA, 50 bp, Homo sapiens
cccagtgcttcacgaagttaaaggaaagatctgctggtagtgtttagtct

SEQ ID NO: 7287 - DNA, 50 bp, Homo sapiens
cgagccgaccatgtcttcatttgcttccacaagaaccgcgaggacagagc

SEQ ID NO: 7288 - DNA, 50 bp, Homo sapiens
ttttccccctttagtctcctggctttttcctttcccttcccttctccact

SEQ ID NO: 7289 - DNA, 50 bp, Homo sapiens
aacccgttgtggaaattattggaattaactgagccaaagtgattatgcat

SEQ ID NO: 7290 - DNA, 50 bp, Homo sapiens
gcccccgatcctacaccctgagcctcagagcactgctactttttaaaata

SEQ ID NO: 7291 - DNA, 50 bp, Homo sapiens
aagcgtctcatggagttcggactggttggggtgataatatttgtttcttt

SEQ ID NO: 7292 - DNA, 50 bp, Homo sapiens
aagccaggctttgggatacaagttctttcctcttcatttgatgccgtgca

SEQ ID NO: 7293 - DNA, 50 bp, Homo sapiens
agctgtcaccactacagtaagctggtttacagatgttttccactgagcat

SEQ ID NO: 7294 - DNA, 50 bp, Homo sapiens
tgaaggtacatcgtttgcaaatgtgagtttcctctcctgtccgtgtttgt

SEQ ID NO: 7295 - DNA, 50 bp, Homo sapiens
ggatacaaactggtattctgttctggaggaaagggaggagtggaggtggg

SEQ ID NO: 7296 - DNA, 50 bp, Homo sapiens
ctgccgctgcccagccacatcccttggttttgtattttatttacagagtt

SEQ ID NO: 7297 - DNA, 50 bp, Homo sapiens
tgcagtagacgatacaggttgcatgtggacactcagtcacattaacaact

SEQ ID NO: 7298 - DNA, 50 bp, Homo sapiens
ccccaaccacaggcatcaggcaaccatttgaaataaaactccttcagcct

SEQ ID NO: 7299 - DNA, 50 bp, Homo sapiens
gtactgaggtgactggtatagtctgatgagaaagatgtggattgccataa

SEQ ID NO: 7300 - DNA, 50 bp, Homo sapiens
cacttgttcaatcatggaactttctagaacgctgccactcttcaaaggct

SEQ ID NO: 7301 - DNA, 50 bp, Homo sapiens
tcatcacagtgtggtaaggttgcaaattcaaaacatgtcacccaagctct

SEQ ID NO: 7302 - DNA, 50 bp, Homo sapiens
acaacctgatcattgaagccaactttgtcccagcacattccttaagtcct

SEQ ID NO: 7303 - DNA, 50 bp, Homo sapiens
acttgattaggctccggttttcctttggcttctgcttttcagtgaatggc

SEQ ID NO: 7304 - DNA, 50 bp, Homo sapiens
ttgcagacaaattcctctgagcttagctaggagttcattatgcttcctgt

SEQ ID NO: 7305 - DNA, 50 bp, Homo sapiens
acagtagcttagcatcagaggtttgcttcctcagtaacatttctgttctc

SEQ ID NO: 7306 - DNA, 50 bp, Homo sapiens
atgtgagccagagcatgttgcagcaaatctattgtttgtaaaaataacaa

SEQ ID NO: 7307 - DNA, 50 bp, Homo sapiens
tttgtgccatgtggctacattagttgatgtttatcgagttcattggtcaa

SEQ ID NO: 7308 - DNA, 50 bp, Homo sapiens
agcccaaccattaaaaatttaatacaacttggtttctccccctttttcct

SEQ ID NO: 7309 - DNA, 50 bp, Homo sapiens
gcaaagaaagaagaatccgaggagtctgatgatgacatgggctttggtct

SEQ ID NO: 7310 - DNA, 50 bp, Homo sapiens; identical to SEQ ID NO: 6184

SEQ ID NO: 7311 - DNA, 50 bp, Homo sapiens
ttttcctgaccaagactgagggatgggctggaggttttcaactttgctac

SEQ ID NO: 7312 - DNA, 50 bp, Homo sapiens
tctgggactgggcaaatgtttgtgtggcctccttaaactagctgttatgt

SEQ ID NO: 7313 - DNA, 50 bp, Homo sapiens
aacctaaacgtatttcactaactctggctccttctccataaagcacattt

SEQ ID NO: 7314 - DNA, 50 bp, Homo sapiens
ccaccaaatgcatgtcatgtattctcaataggctgtattcccagcagtca

SEQ ID NO: 7315 - DNA, 50 bp, Homo sapiens
tgtacaggtagctaactttgtaaacgctgtgtattccctctgcccccatg

SEQ ID NO: 7316 - DNA, 50 bp, Homo sapiens
tctcatcatttcgaagatagcagagtcatagttgggcacccagtgattgg

SEQ ID NO: 7317 - DNA, 50 bp, Homo sapiens
caacaaggtggaaacaagggctggagctgcgtttgttttgccatcactat

SEQ ID NO: 7318 - DNA, 50 bp, Homo sapiens
gagcattcctcaggggaggtcacctgtgaggttcccagaactgtagtttt

SEQ ID NO: 7319 - DNA, 50 bp, Homo sapiens
tgcaggtgttgacaagatccgccatctgtaatgtccttggcacaataaaa

SEQ ID NO: 7320 - DNA, 50 bp, Homo sapiens
aagagtctgacttctcactaggagcatgtctgttgtacttacttcaaaca

SEQ ID NO: 7321 - DNA, 50 bp, Homo sapiens
caaacaccaaaccaagataacaccggaacgataaacagcagaaacagaga

SEQ ID NO: 7322 - DNA, 50 bp, Homo sapiens
tgggtttgtccagttcaggctagatgtgcatcatggcaggaagaaagaag

SEQ ID NO: 7323 - DNA, 50 bp, Homo sapiens
aaggatgttccttcaggaggaagcagcactaaaagcactctgagtcaaga

SEQ ID NO: 7324 - DNA, 50 bp, Homo sapiens
cggaagccaccgtgtggttctttcacaggcacgtttattttgctgaaata

SEQ ID NO: 7325 - DNA, 50 bp, Homo sapiens
cctccactcagctgtcctgcagcaaacactccaccctccaccttccattt

SEQ ID NO: 7326 - DNA, 50 bp, Homo sapiens
tccctccttccagtgttccttagaacagacatttaggtatctcaggtcct

SEQ ID NO: 7327 - DNA, 50 bp, Homo sapiens
cagccgcagcatctaaacgaacaacagaggagaacgacgaggacagagtt

SEQ ID NO: 7328 - DNA, 50 bp, Homo sapiens
tcactggatttctgtgtcttcactagaacaccattgtcatctcatattga

SEQ ID NO: 7329 - DNA, 50 bp, Homo sapiens
gcttctctcgcacccccagcacctctgtcccaaaacctcattcccttttt

SEQ ID NO: 7330 - DNA, 50 bp, Homo sapiens
agctgctcacagacaccagcaaagcaatgtgctcctgatcaagtagattt

SEQ ID NO: 7331 - DNA, 50 bp, Homo sapiens
atgctcatgtggtgtccccaccgcccacttgtttgatgtcactgactgtc

SEQ ID NO: 7332 - DNA, 50 bp, Homo sapiens
gctgagtgtgtcgctccctggtccactgtttctcctataaatgtaaatgg

SEQ ID NO: 7333 - DNA, 50 bp, Homo sapiens
tgcagcacattgataagatggtttccgtgagctatgataagattgaaatt

SEQ ID NO: 7334 - DNA, 50 bp, Homo sapiens
ataaatatgcagtgatatggcagaagacaccagagcagatgcagagagcc

SEQ ID NO: 7335 - DNA, 50 bp, Homo sapiens
ttgaaccgggaagtgggaggacgtagagcagagaagagaacatttttaaa

SEQ ID NO: 7336 - DNA, 50 bp, Homo sapiens
tttgctcattctaaactcaagcttttaagcctcacagaatttacaggggt

SEQ ID NO: 7337 - DNA, 50 bp, Homo sapiens
gccataggcttacatggggcatactcgttacacagtcagaatgtttgaaa

SEQ ID NO: 7338 - DNA, 50 bp, Homo sapiens
ggtctctcgctctgtctttccagcatccactctcccttgtccttctgggg

SEQ ID NO: 7339 - DNA, 50 bp, Homo sapiens
tcagcaccaagtcatgtttaaaagaccagagagacaagcattttgccaag

SEQ ID NO: 7340 - DNA, 50 bp, Homo sapiens
cgaaccctgtctagaaggaatgtatttgttgctaaatttcgtagcactgt

SEQ ID NO: 7341 - DNA, 50 bp, Homo sapiens
caaatggccttggtcccgcagcttgtgtgcgtgagtgcagtgtgagtgtg

SEQ ID NO: 7342 - DNA, 50 bp, Homo sapiens
ctcttggaaagacttctctgccatccctttgcacctgagaggggaagttc

SEQ ID NO: 7343 - DNA, 50 bp, Homo sapiens
ggcgcggtgacccacttatgggacttggcctttctttgttgtttgtttaa

SEQ ID NO: 7344 - DNA, 52 bp, Homo sapiens
acccagttcatgattacttctactcttaacactcaatccccctaattaaacc

SEQ ID NO: 7345 - DNA, 50 bp, Homo sapiens
ttcgataaacagcgttgacttgcttgtaccacttaagagttgtgagtgct

SEQ ID NO: 7346 - DNA, 50 bp, Homo sapiens
tccagaactttgtctatcactctccccaacaacctagatgtgaaaacaga

SEQ ID NO: 7347 - DNA, 50 bp, Homo sapiens
gggatctttcaaatggatagtgagttgccttttcctataggtgacaatca

SEQ ID NO: 7348 - DNA, 50 bp, Homo sapiens
agagcaagcattacagaaaataggtctggaagacaggaaaaggacaaaga

SEQ ID NO: 7349 - DNA, 50 bp, Homo sapiens
atgtgtcctgcccctcagctctttgccttatctgtgtcactgtcacttta

SEQ ID NO: 7350 - DNA, 50 bp, Homo sapiens
tcctgtgaattgaatttctcttcaatcaaagtgccccaaacagaagcaca

SEQ ID NO: 7351 - DNA, 50 bp, Homo sapiens
aggtcccctgcctggtacaaagaaaagcaaaaagaatttacgaagattgt

SEQ ID NO: 7352 - DNA, 50 bp, Homo sapiens
gccagaagcataatttaccagagacgagaacagggtgtgggagagaggaa

SEQ ID NO: 7353 - DNA, 50 bp, Homo sapiens
tctttcttccctcgtgacagtggtgtgtggtgtcgtctgtgaatgctaag

SEQ ID NO: 7354 - DNA, 50 bp, Homo sapiens
cagtcaaacattttaccttgtgccttggctcactctgtgccttttctcca

SEQ ID NO: 7355 - DNA, 50 bp, Homo sapiens
acaggaaacgggctttctctgaattggtaaatgggaaagaagtgagcaac

SEQ ID NO: 7356 - DNA, 50 bp, Homo sapiens; identical to SEQ ID NO: 4610

SEQ ID NO: 7357 - DNA, 50 bp, Homo sapiens
accctcgccacaagattctgcaatctcctaaagtacagatgagaaaggaa

SEQ ID NO: 7358 - DNA, 50 bp, Homo sapiens
tgccaaggggttaatgaaacaaatagctgttgacgtttgctcatttaaga

SEQ ID NO: 7359 - DNA, 50 bp, Homo sapiens
cagtggcacaccttaaccagtcactaattttcactgttgtgaaagtgatt

SEQ ID NO: 7360 - DNA, 50 bp, Homo sapiens
cccagtgccacagagaagacgggatttgaagctgtacccaatttaattcc

SEQ ID NO: 7361 - DNA, 50 bp, Homo sapiens
tgagccctactccctgcagatgccaccctagccaatgtctcctccccttc

SEQ ID NO: 7362 - DNA, 50 bp, Homo sapiens
gcagggaggggaggataagtgggatctaccaattgattctggcaaaacaa

SEQ ID NO: 7363 - DNA, 50 bp, Homo sapiens
ggccactacctttgttggaaacaaagcataagggagtgaaagtgtctaaa

SEQ ID NO: 7364 - DNA, 50 bp, Homo sapiens
gctggcccgatctctccccacagttgcaagaagcattttcaaagaatagt

SEQ ID NO: 7365 - DNA, 50 bp, Homo sapiens
attgggatgaaactactttagcaaagtccacagatcagaaaccagacggt

SEQ ID NO: 7366 - DNA, 50 bp, Homo sapiens
aggagactgggtgctataattagattattttgaggcagacagagagctgt

SEQ ID NO: 7367 - DNA, 50 bp, Homo sapiens
agcctgcaaggttaggacttgaagagggaaggtatttaataactgggcga

SEQ ID NO: 7368 - DNA, 50 bp, Homo sapiens
ttagtgcagttggaatgaatgtgtataggtcagaggtcttcgtgttcaca

SEQ ID NO: 7369 - DNA, 50 bp, Homo sapiens
tcacctctcagttgaaagatttcttctttgaaaggtcaagaccgtgaact

SEQ ID NO: 7370 - DNA, 50 bp, Homo sapiens
agtctggatgtaaggcctgcctcaaagagacactaatgggagggaacaaa

SEQ ID NO: 7371 - DNA, 50 bp, Homo sapiens
aaaggaagaagcacgatgcaaacagaaacaagacgagacagagtgagcga

SEQ ID NO: 7372 - DNA, 50 bp, Homo sapiens
actgcttcaagtcttgacccctttgtgtctaatagctaaacaaacatgtg

SEQ ID NO: 7373 - DNA, 50 bp, Homo sapiens
aacaataggaataaggttacttcagccttaaggggcttatcatactgctg

SEQ ID NO: 7374 - DNA, 50 bp, Homo sapiens
gacagggaaatctgcctaccaagaggggtgtgtgtgtctttgtgcccaca

SEQ ID NO: 7375 - DNA, 50 bp, Homo sapiens
aacaagtccatgactcccaagggtttaaggaccaatggttcagtgagaca

SEQ ID NO: 7376 - DNA, 50 bp, Homo sapiens
acactcatactcatatgtacgtgctcagtcgaacggactgcagtccgttc

SEQ ID NO: 7377 - DNA, 50 bp, Homo sapiens
tactgctatggaatgagaccaccacttctcctgttgtccttcccagcttc

SEQ ID NO: 7378 - DNA, 50 bp, Homo sapiens
tgccaagtgaggacaaactgctaggctgtatcccataatttcaggatgag

SEQ ID NO: 7379 - DNA, 50 bp, Homo sapiens
aaaccgaccgcctgtaggctcctggaactatacagataggtaaagagttc

SEQ ID NO: 7380 - DNA, 50 bp, Homo sapiens
gaccaatcatcagactccttgaactcccccactctgctggctctgtaacc

SEQ ID NO: 7381 - DNA, 50 bp, Homo sapiens
agagatccaggtgcaagtggattgagacagcagcaacagctcaagagata

SEQ ID NO: 7382 - DNA, 50 bp, Homo sapiens
atgtccctttctcctctcccctcttcctcttactgctgttctccctttct

SEQ ID NO: 7383 - DNA, 50 bp, Homo sapiens
acatccatagaacaatacatcaaagttgttgaagtgttgcaggggagggc

SEQ ID NO: 7384 - DNA, 50 bp, Homo sapiens
agcacttactgtcaggcattcagaatgtgagcaatgacaataatttacct

SEQ ID NO: 7385 - DNA, 50 bp, Homo sapiens
aatctgattgagtctccactccacaagcactcagggttccccagcagctc

SEQ ID NO: 7386 - DNA, 50 bp, Homo sapiens
aacccaagaaaagagttgctcttactatctactgctgactcttgaacttt

SEQ ID NO: 7387 - DNA, 50 bp, Homo sapiens
ttcgtaggtgggcttttcctatcagagcttggctcataaccaaataaagt

SEQ ID NO: 7388 - DNA, 50 bp, Homo sapiens
aggtgggctggacttctacctgccctcaagggtgtgtatattgtataggg

SEQ ID NO: 7389 - DNA, 50 bp, Homo sapiens
tgtgtcagaatggcactagttcagtttatgtcccttctgatatagtagct

SEQ ID NO: 7390 - DNA, 50 bp, Homo sapiens
ctatcagccccaagtggagcagaacagagggatttgggaggaatgtcctc

SEQ ID NO: 7391 - DNA, 50 bp, Homo sapiens
tgctaaggagaggggccatgaagagttttgttgagaacatcgtgtctgag

SEQ ID NO: 7392 - DNA, 50 bp, Homo sapiens
agtcagaacttcaagtccccattaaaggggctggaaaatacaagtacagt

SEQ ID NO: 7393 - DNA, 50 bp, Homo sapiens
ctccccttcctgcacccgtacccccgtggtctttgaataaagtctgagtg

SEQ ID NO: 7394 - DNA, 50 bp, Homo sapiens
cagatggttgtggggtcaagtacatccccagtcgtggccctttggacaag

SEQ ID NO: 7395 - DNA, 50 bp, Homo sapiens
ttttggcctgtttgatgtatgtgtgaaacaatgttgtccaacaataaaca

SEQ ID NO: 7396 - DNA, 50 bp, Homo sapiens
agcctaggtgacagagcaagactccatttcaaaaacaaaacaaaacaaaa

SEQ ID NO: 7397 - DNA, 50 bp, Homo sapiens
acactgagaatacacgacatacacgcacgcacaagacaacaacagacagc

SEQ ID NO: 7398 - DNA, 50 bp, Homo sapiens; identical to SEQ ID NO: 6714

SEQ ID NO: 7399 - DNA, 50 bp, Homo sapiens; identical to SEQ ID NO: 6715

SEQ ID NO: 7400 - DNA, 50 bp, Homo sapiens; identical to SEQ ID NO: 6716

SEQ ID NO: 7401 - DNA, 50 bp, Homo sapiens; identical to SEQ ID NO: 6717

SEQ ID NO: 7402 - DNA, 50 bp, Homo sapiens; identical to SEQ ID NO: 6718

SEQ ID NO: 7403 - DNA, 50 bp, Homo sapiens; identical to SEQ ID NO: 6719

SEQ ID NO: 7404 - DNA, 50 bp, Homo sapiens; identical to SEQ ID NO: 6720

SEQ ID NO: 7405 - DNA, 50 bp, Homo sapiens; identical to SEQ ID NO: 6721

SEQ ID NO: 7406 - DNA, 50 bp, Homo sapiens; identical to SEQ ID NO: 6722

SEQ ID NO: 7407 - DNA, 50 bp, Homo sapiens; identical to SEQ ID NO: 6723

SEQ ID NO: 7408 - DNA, 50 bp, Homo sapiens; identical to SEQ ID NO: 6724

SEQ ID NO: 7409 - DNA, 50 bp, Homo sapiens; identical to SEQ ID NO: 6725

SEQ ID NO: 7410 - DNA, 50 bp, Homo sapiens; identical to SEQ ID NO: 6726

SEQ ID NO: 7411 - DNA, 50 bp, Homo sapiens; identical to SEQ ID NO: 6727

SEQ ID NO: 7412 - DNA, 50 bp, Homo sapiens; identical to SEQ ID NO: 6728

SEQ ID NO: 7413 - DNA, 50 bp, Homo sapiens; identical to SEQ ID NO: 6729

SEQ ID NO: 7414 - DNA, 50 bp, Homo sapiens; identical to SEQ ID NO: 6730

SEQ ID NO: 7415 - DNA, 50 bp, Homo sapiens; identical to SEQ ID NO: 6731

SEQ ID NO: 7416 - DNA, 50 bp, Homo sapiens; identical to SEQ ID NO: 6732

SEQ ID NO: 7417 - DNA, 50 bp, Homo sapiens; identical to SEQ ID NO: 6733

SEQ ID NO: 7418 - DNA, 50 bp, Homo sapiens; identical to SEQ ID NO: 6734

SEQ ID NO: 7419 - DNA, 50 bp, Homo sapiens; identical to SEQ ID NO: 6735

SEQ ID NO: 7420 - DNA, 50 bp, Homo sapiens; identical to SEQ ID NO: 6736

SEQ ID NO: 7421 - DNA, 50 bp, Homo sapiens; identical to SEQ ID NO: 6737

SEQ ID NO: 7422 - DNA, 50 bp, Homo sapiens; identical to SEQ ID NO: 6738

SEQ ID NO: 7423 - DNA, 50 bp, Homo sapiens; identical to SEQ ID NO: 4953

SEQ ID NO: 7424 - DNA, 50 bp, Homo sapiens; identical to SEQ ID NO: 6740

SEQ ID NO: 7425 - DNA, 50 bp, Homo sapiens; identical to SEQ ID NO: 6741

SEQ ID NO: 7426 - DNA, 50 bp, Homo sapiens; identical to SEQ ID NO: 6742

SEQ ID NO: 7427 - DNA, 50 bp, Homo sapiens; identical to SEQ ID NO: 6743

SEQ ID NO: 7428 - DNA, 50 bp, Homo sapiens; identical to SEQ ID NO: 6744

SEQ ID NO: 7429 - DNA, 50 bp, Homo sapiens; identical to SEQ ID NO: 6745

SEQ ID NO: 7430 - DNA, 50 bp, Homo sapiens; identical to SEQ ID NO: 6746

SEQ ID NO: 7431 - DNA, 50 bp, Homo sapiens; identical to SEQ ID NO: 6540

SEQ ID NO: 7432 - DNA, 50 bp, Homo sapiens; identical to SEQ ID NO: 6748

SEQ ID NO: 7433 - DNA, 50 bp, Homo sapiens; identical to SEQ ID NO: 6749

SEQ ID NO: 7434 - DNA, 50 bp, Homo sapiens; identical to SEQ ID NO: 6750

SEQ ID NO: 7435 - DNA, 50 bp, Homo sapiens; identical to SEQ ID NO: 6751

SEQ ID NO: 7436 - DNA, 56 bp, Homo sapiens
acaaaagtatggaattcaattctttttatatgctgcagccatgttcctgccctaga

SEQ ID NO: 7437 - DNA, 50 bp, Homo sapiens; identical to SEQ ID NO: 6753

SEQ ID NO: 7438 - DNA, 50 bp, Homo sapiens; identical to SEQ ID NO: 6754

SEQ ID NO: 7439 - DNA, 50 bp, Homo sapiens; identical to SEQ ID NO: 6755

SEQ ID NO: 7440 - DNA, 50 bp, Homo sapiens; identical to SEQ ID NO: 6756

SEQ ID NO: 7441 - DNA, 50 bp, Homo sapiens; identical to SEQ ID NO: 6757

SEQ ID NO: 7442 - DNA, 50 bp, Homo sapiens; identical to SEQ ID NO: 6758

SEQ ID NO: 7443 - DNA, 50 bp, Homo sapiens; identical to SEQ ID NO: 6759

SEQ ID NO: 7444 - DNA, 50 bp, Homo sapiens; identical to SEQ ID NO: 6760

SEQ ID NO: 7445 - DNA, 50 bp, Homo sapiens; identical to SEQ ID NO: 6761

SEQ ID NO: 7446 - DNA, 50 bp, Homo sapiens; identical to SEQ ID NO: 6762

SEQ ID NO: 7447 - DNA, 50 bp, Homo sapiens; identical to SEQ ID NO: 6763

SEQ ID NO: 7448 - DNA, 50 bp, Homo sapiens; identical to SEQ ID NO: 6764

SEQ ID NO: 7449 - DNA, 50 bp, Homo sapiens; identical to SEQ ID NO: 6765

SEQ ID NO: 7450 - DNA, 50 bp, Homo sapiens; identical to SEQ ID NO: 6766

SEQ ID NO: 7451 - DNA, 50 bp, Homo sapiens; identical to SEQ ID NO: 6767

SEQ ID NO: 7452 - DNA, 50 bp, Homo sapiens; identical to SEQ ID NO: 6768

SEQ ID NO: 7453 - DNA, 50 bp, Homo sapiens; identical to SEQ ID NO: 6769

SEQ ID NO: 7454 - DNA, 50 bp, Homo sapiens; identical to SEQ ID NO: 6770

SEQ ID NO: 7455 - DNA, 50 bp, Human cytomegalovirus; identical to SEQ ID NO: 4173

SEQ ID NO: 7456 - DNA, 50 bp, Human cytomegalovirus
ttttgcgaacttttaggaaccagcaagtcaacaaaagactaacaaagaaa

SEQ ID NO: 7457 - DNA, 50 bp, Homo sapiens; identical to SEQ ID NO: 4181

SEQ ID NO: 7458 - DNA, 50 bp, Homo sapiens; identical to SEQ ID NO: 4174

SEQ ID NO: 7459 - DNA, 50 bp, Human cytomegalovirus; identical to SEQ ID NO: 4177

SEQ ID NO: 7460 - DNA, 50 bp, Human cytomegalovirus; identical to SEQ ID NO: 4182

SEQ ID NO: 7461 - DNA, 50 bp, Human cytomegalovirus; identical to SEQ ID NO: 4179

SEQ ID NO: 7462 - DNA, 50 bp, Human cytomegalovirus; identical to SEQ ID NO: 4183

SEQ ID NO: 7463 - DNA, 50 bp, Human cytomegalovirus; identical to SEQ ID NO: 4175

SEQ ID NO: 7464 - DNA, 50 bp, Human cytomegalovirus; identical to SEQ ID NO: 4184

SEQ ID NO: 7465 - DNA, 50 bp, Human cytomegalovirus
ctgcatcgtcgtcgtcctcctcctctcggagatcgcgacggagaaacaac

SEQ ID NO: 7466 - DNA, 50 bp, Human cytomegalovirus
ctgagcctggccatcgaggcagccatccaggacctgaggaacaagtctca

SEQ ID NO: 7467 - DNA, 50 bp, Human cytomegalovirus; identical to SEQ ID NO: 4178

SEQ ID NO: 7468 - DNA, 50 bp, Human cytomegalovirus; identical to SEQ ID NO: 4180

SEQ ID NO: 7469 - DNA, 50 bp, Human adenovirus type 2
ctgtggaatgtatcgaggacttgcttaacgagtctgggcaacctttggac

SEQ ID NO: 7470 - DNA, 50 bp, Human adenovirus type 2
gctggcctgcacccgcgctgagtttggctctagcgatgaagatacagatt

SEQ ID NO: 7471 - DNA, 50 bp, Human adenovirus type 2
ggggcggttaggctgtcctccttctcgactgactccatgatctttttctg

SEQ ID NO: 7472 - DNA, 50 bp, Human adenovirus type 2
tgtttgccttattattatgtggcttatttgttgcctaaagcgcagacgcg

SEQ ID NO: 7473 - DNA, 50 bp, Homo sapiens
acggtgatcaatataagctatgtggtggtggggctatactactgaatgaa

SEQ ID NO: 7474 - DNA, 50 bp, Human adenovirus type 2
tttctgccctgaaggcttcctcccctcccaatgcggtttaaaacataaat

SEQ ID NO: 7475 - DNA, 50 bp, Human adenovirus type 2
ggcttatgcccatgtatctgaacatccagagtcacctttaccacgtcctg

SEQ ID NO: 7476 - DNA, 50 bp, Human adenovirus type 2
ctactgccgtacagcgaaagccgccccaacccgcgaaacgaggagatatg

SEQ ID NO: 7477 - DNA, 50 bp, Homo sapiens; identical to SEQ ID NO: 7104

SEQ ID NO: 7478 - DNA, 50 bp, Homo sapiens; identical to SEQ ID NO: 7105

SEQ ID NO: 7479 - DNA, 50 bp, Homo sapiens; identical to SEQ ID NO: 7106

SEQ ID NO: 7480 - DNA, 50 bp, Homo sapiens; identical to SEQ ID NO: 7107

SEQ ID NO: 7481 - DNA, 50 bp, Homo sapiens; identical to SEQ ID NO: 7108

SEQ ID NO: 7482 - DNA, 50 bp, Homo sapiens; identical to SEQ ID NO: 7109

SEQ ID NO: 7483 - DNA, 50 bp, Homo sapiens; identical to SEQ ID NO: 7110

SEQ ID NO: 7484 - DNA, 50 bp, Homo sapiens; identical to SEQ ID NO: 7111

SEQ ID NO: 7485 - DNA, 50 bp, Homo sapiens; identical to SEQ ID NO: 7112

SEQ ID NO: 7486 - DNA, 50 bp, Homo sapiens; identical to SEQ ID NO: 7113

SEQ ID NO: 7487 - DNA, 50 bp, Homo sapiens; identical to SEQ ID NO: 7114

SEQ ID NO: 7488 - DNA, 50 bp, Homo sapiens; identical to SEQ ID NO: 7115

SEQ ID NO: 7489 - DNA, 50 bp, Homo sapiens; identical to SEQ ID NO: 7116

SEQ ID NO: 7490 - DNA, 50 bp, Homo sapiens; identical to SEQ ID NO: 7117

SEQ ID NO: 7491 - DNA, 50 bp, Homo sapiens; identical to SEQ ID NO: 7118

SEQ ID NO: 7492 - DNA, 50 bp, Homo sapiens; identical to SEQ ID NO: 7119

SEQ ID NO: 7493 - DNA, 50 bp, Homo sapiens; identical to SEQ ID NO: 7120

SEQ ID NO: 7494 - DNA, 50 bp, Homo sapiens; identical to SEQ ID NO: 7121

SEQ ID NO: 7495 - DNA, 50 bp, Homo sapiens; identical to SEQ ID NO: 7122

SEQ ID NO: 7496 - DNA, 50 bp, Homo sapiens; identical to SEQ ID NO: 7123

SEQ ID NO: 7497 - DNA, 50 bp, Homo sapiens; identical to SEQ ID NO: 7124

SEQ ID NO: 7498 - DNA, 50 bp, Homo sapiens; identical to SEQ ID NO: 7125

SEQ ID NO: 7499 - DNA, 50 bp, Homo sapiens; identical to SEQ ID NO: 7126

SEQ ID NO: 7500 - DNA, 50 bp, Homo sapiens; identical to SEQ ID NO: 7127

SEQ ID NO: 7501 - DNA, 50 bp, Homo sapiens; identical to SEQ ID NO: 7128

SEQ ID NO: 7502 - DNA, 50 bp, Homo sapiens; identical to SEQ ID NO: 7129

SEQ ID NO: 7503 - DNA, 50 bp, Homo sapiens; identical to SEQ ID NO: 7130

SEQ ID NO: 7504 - DNA, 50 bp, Homo sapiens; identical to SEQ ID NO: 7131

SEQ ID NO: 7505 - DNA, 50 bp, Homo sapiens; identical to SEQ ID NO: 7132

SEQ ID NO: 7506 - DNA, 50 bp, Homo sapiens; identical to SEQ ID NO: 7133

SEQ ID NO: 7507 - DNA, 50 bp, Homo sapiens; identical to SEQ ID NO: 7134

SEQ ID NO: 7508 - DNA, 50 bp, Homo sapiens; identical to SEQ ID NO: 7135

SEQ ID NO: 7509 - DNA, 50 bp, Homo sapiens; identical to SEQ ID NO: 7136

SEQ ID NO: 7510 - DNA, 50 bp, Homo sapiens; identical to SEQ ID NO: 6930

SEQ ID NO: 7511 - DNA, 50 bp, Homo sapiens; identical to SEQ ID NO: 7138

SEQ ID NO: 7512 - DNA, 50 bp, Homo sapiens; identical to SEQ ID NO: 7139

SEQ ID NO: 7513 - DNA, 50 bp, Homo sapiens; identical to SEQ ID NO: 7140

SEQ ID NO: 7514 - DNA, 50 bp, Homo sapiens; identical to SEQ ID NO: 7141

SEQ ID NO: 7515 - DNA, 56 bp, Homo sapiens
tctagggcaggaacatggctgcagcatataaaaagaattgaattccatacttttgt

SEQ ID NO: 7516 - DNA, 50 bp, Homo sapiens; identical to SEQ ID NO: 7143

SEQ ID NO: 7517 - DNA, 50 bp, Homo sapiens; identical to SEQ ID NO: 7144

SEQ ID NO: 7518 - DNA, 50 bp, Homo sapiens; identical to SEQ ID NO: 7145

SEQ ID NO: 7519 - DNA, 50 bp, Homo sapiens; identical to SEQ ID NO: 7146

SEQ ID NO: 7520 - DNA, 50 bp, Homo sapiens; identical to SEQ ID NO: 7147

SEQ ID NO: 7521 - DNA, 50 bp, Homo sapiens; identical to SEQ ID NO: 7148

SEQ ID NO: 7522 - DNA, 50 bp, Homo sapiens; identical to SEQ ID NO: 7149

SEQ ID NO: 7523 - DNA, 50 bp, Homo sapiens; identical to SEQ ID NO: 7150

SEQ ID NO: 7524 - DNA, 50 bp, Homo sapiens; identical to SEQ ID NO: 7151

SEQ ID NO: 7525 - DNA, 50 bp, Homo sapiens; identical to SEQ ID NO: 7152

SEQ ID NO: 7526 - DNA, 50 bp, Homo sapiens; identical to SEQ ID NO: 7153

SEQ ID NO: 7527 - DNA, 50 bp, Homo sapiens; identical to SEQ ID NO: 7154

SEQ ID NO: 7528 - DNA, 50 bp, Homo sapiens; identical to SEQ ID NO: 7155

SEQ ID NO: 7529 - DNA, 50 bp, Homo sapiens; identical to SEQ ID NO: 7156

SEQ ID NO: 7530 - DNA, 50 bp, Homo sapiens; identical to SEQ ID NO: 7157

SEQ ID NO: 7531 - DNA, 50 bp, Homo sapiens; identical to SEQ ID NO: 7158

SEQ ID NO: 7532 - DNA, 50 bp, Homo sapiens; identical to SEQ ID NO: 7159

SEQ ID NO: 7533 - DNA, 50 bp, Homo sapiens; identical to SEQ ID NO: 7160

SEQ ID NO: 7534 - DNA, 50 bp, Homo sapiens
tactggcgtcgagcccactgcctcagaagacttcctttcatctgttccta

SEQ ID NO: 7535 - DNA, 50 bp, Homo sapiens
gtttcaagggacatcttcagagccaacatctaccctcggggctttgtgaa

SEQ ID NO: 7536 - DNA, 50 bp, Homo sapiens
ctacagttctaccataaacactcagtccccgtgtacttccctgcacagga

SEQ ID NO: 7537 - DNA, 50 bp, Homo sapiens
tagttgcatgtgacaacagagatcaacgacgagaccctccacagtatccg

SEQ ID NO: 7538 - DNA, 50 bp, Homo sapiens
ttgaccatagaatcaagcctgaggctgtgaagatggtgcaagtgtggaga

SEQ ID NO: 7539 - DNA, 50 bp, Homo sapiens
ctgctgtcttcacccgaatctcccattaccggccctggatcaaccagatc

SEQ ID NO: 7540 - DNA, 50 bp, Homo sapiens
gtcactggaggaccaacccctgctgtccaaaacaccactgcttcctaccc

SEQ ID NO: 7541 - DNA, 50 bp, Human herpesvirus type 4
catgccatgcatatttcaactgggctgtctatttttgacaccagcttatt

SEQ ID NO: 7542 - DNA, 50 bp, Human herpesvirus type 4
gagaagcacctcaacctggagacaattctactgttcaaacagcagcagca

SEQ ID NO: 7543 - DNA, 50 bp, Human herpesvirus type 4
acttgtcagggccattctctctccgggcactgggtcactaggactgtttt

SEQ ID NO: 7544 - DNA, 50 bp, Human herpesvirus type 4
gacagcgtcctagaaaccctggcgaccattgcctccagcgggatagagtg

SEQ ID NO: 7545 - DNA, 50 bp, Human herpesvirus type 4
catcctctggagcctgacctgtgatcgtcgcatcatagaccgccagtaga

SEQ ID NO: 7546 - DNA, 50 bp, Human herpesvirus type 4
gcctccacacgacatcacaccatataccgcaaggaatatcagggatgctg

SEQ ID NO: 7547 - DNA, 50 bp, Homo sapiens
acagccatcctccccttgagagtcatcagaaaaatacattaggaaaatgt

SEQ ID NO: 7548 - DNA, 50 bp, Human herpesvirus type 4
accttcgtcttctgagtctcatgcctcaaaacctagtttgatagacagga

SEQ ID NO: 7549 - DNA, 50 bp, Human herpesvirus type 4
agatggctacccttctgattatgatcctttcgtagaaaatgctcaaatct

SEQ ID NO: 7550 - DNA, 50 bp, Human herpesvirus type 4
atgcatcgccgacaagtcttgaattaggattgtcgaaattagacaaagaa

SEQ ID NO: 7551 - DNA, 50 bp, Human herpesvirus type 4
cgggtgtgttcaatcatcgacggtgacaatcctatctccatctataatcc

SEQ ID NO: 7552 - DNA, 50 bp, Human herpesvirus type 4
gaagagcgaaatgcaatcttctgcttcttcagtagagactttacagtctt

SEQ ID NO: 7553 - DNA, 50 bp, Human herpesvirus type 4
gcacatccatcgcccaaagtgaagtctgcaaggatgccatttattggttg

SEQ ID NO: 7554 - DNA, 50 bp, Human herpesvirus type 4
tctcggtttacctttttgctgttgtggttctttgttcttgctggtttgct

SEQ ID NO: 7555 - DNA, 50 bp, Human herpesvirus 4
tctgaatactctacaaaacgctccttgtctgctcttaaaaccatctgtgt

SEQ ID NO: 7556 - DNA, 50 bp, Human herpesvirus 6
tgaagctgacacctgtgaaactaacttaaacgcatgttcttctgactcag

SEQ ID NO: 7557 - DNA, 50 bp, Human herpesvirus 6
ttctgttttgggccaggaaccgttctataaattgttttattgactacacg

SEQ ID NO: 7558 - DNA, 50 bp, Human herpesvirus 6
taacaccgtccaagaaattttgccgttgtgtccccatacttctctagggc

SEQ ID NO: 7559 - DNA, 50 bp, Human herpesvirus 6
agaagaaggatcagatggagagttgaaaactttagctggtaagtacatga

SEQ ID NO: 7560 - DNA, 50 bp, Human herpesvirus 6
ccgataccggcaagatctgtcgtctggcaaactcgttttccaccttatgg

SEQ ID NO: 7561 - DNA, 50 bp, Human herpesvirus 6
ctgtgggtccctccccctcatctgttattcccttcccctctgccaccgat

SEQ ID NO: 7562 - DNA, 55 bp, Homo sapiens
actacattttaattaaagattaatgggcatattagaagtttctcaaagttaggct

SEQ ID NO: 7563 - DNA, 50 bp, Homo sapiens
aaaaggagtgagctatcatcagtgctgtgaaataaaagtctggtgtgcca

SEQ ID NO: 7564 - DNA, 50 bp, Homo sapiens
aaagccaccactgttcccagtcagcatatacaagctcttaatattctgtt

SEQ ID NO: 7565 - DNA, 50 bp, Homo sapiens
aaatgtgggataacgcgatgactgtgaccctggttggaaattaaacttgt

SEQ ID NO: 7566 - DNA, 50 bp, Homo sapiens
aacacagaaacatttgagcattgtatttctcgcatcccttctcgtgagcg

SEQ ID NO: 7567 - DNA, 50 bp, Homo sapiens
aacctatcaaagcctagcctaagggctgccatctctgtctaaattctagt

SEQ ID NO: 7568 - DNA, 50 bp, Homo sapiens
aactgcatggtatgaattcagagtgtgacttaagggtcaattcaaagcag

SEQ ID NO: 7569 - DNA, 50 bp, Homo sapiens
acagactttgttaatgtaggaaatctctccaagtggaaacgtgctaactt

SEQ ID NO: 7570 - DNA, 50 bp, Homo sapiens
acaggcaattcagtggactataataatagtggagggttgagatgtagagt

SEQ ID NO: 7571 - DNA, 50 bp, Homo sapiens
acaggtcacagtggatttcttttcaaactgacaatgtttaggttttaagc

SEQ ID NO: 7572 - DNA, 50 bp, Homo sapiens
acctcaagcagatgagattcaggtaattgaagaggcagatgaagaggaat

SEQ ID NO: 7573 - DNA, 50 bp, Homo sapiens
accttctacaccactggaaaataacatggaggtttagagccgtgcaaaat

SEQ ID NO: 7574 - DNA, 50 bp, Homo sapiens
actaaactctgaggcctgaagttctgtgatagaccttaaataagtgtcct

SEQ ID NO: 7575 - DNA, 50 bp, Homo sapiens
actggggtggtgatgttttcgttctgttttatttttctaactctgctgac

SEQ ID NO: 7576 - DNA, 50 bp, Homo sapiens
acttcatcataatttggagggaagctcttggagctgtgagttctccctgt

SEQ ID NO: 7577 - DNA, 50 bp, Homo sapiens
agaacgaggaagagaacacaaggaatgattcaagatccaccttgagagga

SEQ ID NO: 7578 - DNA, 50 bp, Homo sapiens
agagaataggctttctaagatgctgcgatcccgttctgctgcccgtaata

SEQ ID NO: 7579 - DNA, 50 bp, Homo sapiens
agcacaagccacgcttcaccaccaagaggcccaacaccttcttctaggtg

SEQ ID NO: 7580 - DNA, 50 bp, Homo sapiens
aggccaatcactgctgactaagaattcattatattggcttagtacacaga

SEQ ID NO: 7581 - DNA, 50 bp, Homo sapiens
agggaagatttctgtatacttgctggagaggaggaatgtgtatagttact

SEQ ID NO: 7582 - DNA, 50 bp, Homo sapiens
agttttaataccttaagctttttcaagacctaactgcagccgctttggga

SEQ ID NO: 7583 - DNA, 50 bp, Homo sapiens
atgtgctgtaaagtttcttctttccagtaaagactagccattgcattggc

SEQ ID NO: 7584 - DNA, 50 bp, Homo sapiens
attgtgggtggctctgtgggcgcatcaataaaagccgtccttgattttat

SEQ ID NO: 7585 - DNA, 50 bp, Homo sapiens
atttgagtgttgttggaccatgtgtgatcagactgctatctgaataaaat

SEQ ID NO: 7586 - DNA, 50 bp, Homo sapiens
caagcccacccagccgcacacaggcctagaggtaaccaataaagtattag

SEQ ID NO: 7587 - DNA, 50 bp, Homo sapiens
caccagagacaagcagagtaacaggatcagtgggtctaagtgtccgagac

SEQ ID NO: 7588 - DNA, 50 bp, Homo sapiens
caggaggtagggatctggctgagagggaataatctgagcaaaggtatgaa

SEQ ID NO: 7589 - DNA, 50 bp, Homo sapiens
cagtccctctcccaggaggaccctagaggcaattaaatgatgtcctgttc

SEQ ID NO: 7590 - DNA, 50 bp, Homo sapiens
catgagaagtatctgcaataaccccaagtcaacatttaggtttgtgtaca

SEQ ID NO: 7591 - DNA, 50 bp, Homo sapiens
catgttgagtaggaataaataaatctgatgctgcctcctgaggctgcggg

SEQ ID NO: 7592 - DNA, 50 bp, Homo sapiens
ccaccacctctgtggcattgaaatgagcacctccattaaagtctgaatca

SEQ ID NO: 7593 - DNA, 50 bp, Homo sapiens
ccatgccgcctcgttggattgtcggaatgtagacagaaatgtactgttct

SEQ ID NO: 7594 - DNA, 50 bp, Homo sapiens
cccaccgctttgtgagccgtgtcgtatgacctagtaaactttgtaccaat

SEQ ID NO: 7595 - DNA, 50 bp, Homo sapiens
cccacgggagactatttcacacaatttaatacaggaagtcgataatgagg

SEQ ID NO: 7596 - DNA, 50 bp, Homo sapiens
ccctccgtgaggaacacaatctcaatcgttgctgaatcctttcatatcct

SEQ ID NO: 7597 - DNA, 50 bp, Homo sapiens
ccgtgtctttccagccctaaaggaagggcagacccgtgtctttccatgcc

SEQ ID NO: 7598 - DNA, 50 bp, Homo sapiens
cctgaagcacttcacctggaattgatgtgtaggcttaaggagtatgtgac

SEQ ID NO: 7599 - DNA, 50 bp, Homo sapiens
cgcaggcaagagcactcatcaagatagatgtgaacaaaacccggaaaatc

SEQ ID NO: 7600 - DNA, 50 bp, Homo sapiens
cgctcaaaggtcactgagacttttgcctcacctaaagagaccaaggctca

SEQ ID NO: 7601 - DNA, 50 bp, Homo sapiens
cggcctcagtccctactctgctttgggatagtgtgagcttcattttgtac

SEQ ID NO: 7602 - DNA, 50 bp, Homo sapiens
ctagtgtgtgcttgccttgtccctcggggtagatgcttagctggcagtat

SEQ ID NO: 7603 - DNA, 50 bp, Homo sapiens
ctttcagattccctctggtctccgtccgaaacgtctacctcttcccaggc

SEQ ID NO: 7604 - DNA, 50 bp, Homo sapiens
gaaattcacaggccagggcacatcttttatttatttcattatgttggcca

SEQ ID NO: 7605 - DNA, 50 bp, Homo sapiens
gactccctcaacaccccaaaactctaaatgccacggtcatctgtttctat

SEQ ID NO: 7606 - DNA, 50 bp, Homo sapiens
gagcagccacaaaactgtaacctcaaggaaaccataaagcttggagtgcc

SEQ ID NO: 7607 - DNA, 50 bp, Homo sapiens
gcagcaaacagagggtcagtcacaggatgttctgacacaccattgtaact

SEQ ID NO: 7608 - DNA, 50 bp, Homo sapiens
gccaacaatgctgaccggtgcttatcctctaagccctgatccacaataaa

SEQ ID NO: 7609 - DNA, 50 bp, Homo sapiens
gccagtgtaatttctgtcaaccacggacgtttgccttcatgtgtagaatt

SEQ ID NO: 7610 - DNA, 50 bp, Homo sapiens
gcccaagcactagtagagatgcgcgatacaggtctagtttcggtaactgt

SEQ ID NO: 7611 - DNA, 50 bp, Homo sapiens
ggccagattttgactcccagattcctttacaaaacgcactcattcattca

SEQ ID NO: 7612 - DNA, 50 bp, Homo sapiens
gggactccccgcgtgataaattattaatgttccgcagtctcactctgaat

SEQ ID NO: 7613 - DNA, 50 bp, Homo sapiens
gggactgcatgggaagcacggaatatagggttagatgtgtgttatctgta

SEQ ID NO: 7614 - DNA, 50 bp, Homo sapiens
ggggttcgtgtctttggcatcaacaaatactgagggatgggttttgggac

SEQ ID NO: 7615 - DNA, 50 bp, Homo sapiens
gggtgacctgttctctagctgtgatcttaccacttcaaatgggtgtaatt

SEQ ID NO: 7616 - DNA, 50 bp, Homo sapiens
ggtgtgaacgggctgacttggtgaattgggcaactccttatagtgttgtg

SEQ ID NO: 7617 - DNA, 50 bp, Homo sapiens
gtaccacttgaatgatttcagtcaattttgaacccctttggaaagaggtg

SEQ ID NO: 7618 - DNA, 50 bp, Homo sapiens
gtgaaaccccgtctctgctaaaaatacaaaaattagctgggcgtggtggc

SEQ ID NO: 7619 - DNA, 50 bp, Homo sapiens
gttctctgggttgtgctttactccacgcatcaataaataattttgaaggc

SEQ ID NO: 7620 - DNA, 50 bp, Homo sapiens
tactgccaactgaccttataaccctctgcaccttcaaaaagattcatggt

SEQ ID NO: 7621 - DNA, 50 bp, Homo sapiens
tcaaacagtgacatctcttgggaaaatggacttaataggaatatgggact

SEQ ID NO: 7622 - DNA, 50 bp, Homo sapiens
tcacttcctctgaactgttactgcctgaatggagtcctggacgacattgg

SEQ ID NO: 7623 - DNA, 50 bp, Homo sapiens
tccacttaatagactctatgtgtgctgaatgttcctgtgtacatatgtgt

SEQ ID NO: 7624 - DNA, 50 bp, Homo sapiens
tcccgcagagtgcagagacaggaagctggagatgtctttataaagtcaca

SEQ ID NO: 7625 - DNA, 50 bp, Homo sapiens
tctaggaccctaggaagcttaactctgtcatcatctcaagtatctgcaca

SEQ ID NO: 7626 - DNA, 50 bp, Homo sapiens
tcttccgccatctcctctgataaacacgaggtgtctgccagcacccagag

SEQ ID NO: 7627 - DNA, 50 bp, Homo sapiens
tgatatgttgatcagccttatgtggaagaactgtgataaaaagaggagct

SEQ ID NO: 7628 - DNA, 50 bp, Homo sapiens
tgcagtatttttcaaacttctggtcgcaaacccattagtagtttgtgaaa

SEQ ID NO: 7629 - DNA, 50 bp, Homo sapiens
tgctgctcttgatcccacctttgctcctgacaaccctcattcaataaaga

SEQ ID NO: 7630 - DNA, 50 bp, Homo sapiens
tggtttgttcatggatgtattctaagagctgagaacagggcctggacaca

SEQ ID NO: 7631 - DNA, 50 bp, Homo sapiens
tgttctgaatgttggtagacccttcatagctttgttacaatgaaaccttg

SEQ ID NO: 7632 - DNA, 50 bp, Homo sapiens
tgttgatggatgaattttggcatgatgactgtactctcaataaaggctga

SEQ ID NO: 7633 - DNA, 50 bp, Homo sapiens
ttcatcctgtgagtgctggggaggaggagtagatacagactgagtgagag

SEQ ID NO: 7634 - DNA, 50 bp, Homo sapiens
ttcattttcctgggaagtcaaggttacatcttgcagaggttgttttgaga

SEQ ID NO: 7635 - DNA, 50 bp, Homo sapiens
ttctaagccgaaccaaatcctttgccttgaaagaacagccctaaagtggt

SEQ ID NO: 7636 - DNA, 50 bp, Homo sapiens
tttgtttgtttgtttcagatagggtctccctctgtcacccaggctgcagt

SEQ ID NO: 7637 - DNA, 50 bp, Homo sapiens
ttttgtaaatcacggacacctcaattagcaagaactgaggggagggcttt

SEQ ID NO: 7638 - DNA, 50 bp, Homo sapiens
cggtgtggaaaatgttgtcctttgagtggcaagaattagaaaaatcttca

SEQ ID NO: 7639 - DNA, 50 bp, Homo sapiens
ctgaaagctgaggatcggagcaagtttctggacgcacttatttccctcct

SEQ ID NO: 7640 - DNA, 50 bp, Homo sapiens
gttggcctcagccctgtgggtctgtctcatgctctccctgttcctctccc

SEQ ID NO: 7641 - DNA, 50 bp, Homo sapiens
tagccatacttagcctcagcaggagcctggcctgtaacttataaagtgca

SEQ ID NO: 7642 - DNA, 50 bp, Homo sapiens
tgagggctgtgctgacctttgagaggatttgaaattgcttcatattgtga

SEQ ID NO: 7643 - DNA, 50 bp, Homo sapiens
tgtgtaagaaaaggcccattacttttaaggtatgtgctgtcctattgagc

SEQ ID NO: 7644 - DNA, 50 bp, Homo sapiens
ttgttggtaggcacatcgtgtcaagtgaagtagttttataggtatgggtt

SEQ ID NO: 7645 - DNA, 50 bp, Homo sapiens
tttctagcttttccgtgtatctaaacacaatttgctacacaagtcactgt

SEQ ID NO: 7646 - DNA, 50 bp, Homo sapiens
actgtggcacatgttttgatcagaaaggtagttctctttgctctggtagt

SEQ ID NO: 7647 - DNA, 50 bp, Homo sapiens
catcttctgccctggtcccctttctcttgatgtggaaagtctgaatgcag

SEQ ID NO: 7648 - DNA, 50 bp, Homo sapiens
cgctctaatactgcattctgtttctccttttgtgccctgattgtaatcca

SEQ ID NO: 7649 - DNA, 50 bp, Homo sapiens
ctggagactggagaagtaattccaccaatgaaagaatttcctgatcaaca

SEQ ID NO: 7650 - DNA, 50 bp, Homo sapiens
tcagtgtttcgttattccatatcagtggcttttactgtcaaagattgtgt

SEQ ID NO: 7651 - DNA, 50 bp, Homo sapiens
tgcatgagagccctaggatttaaaatatgaaatggtggtctgctgtgtga

SEQ ID NO: 7652 - DNA, 50 bp, Homo sapiens
tgtgctaagcctgatgaaatgtgctccttcaatctccatgaaaccatcgt

SEQ ID NO: 7653 - DNA, 50 bp, Homo sapiens
aaatgatctccctttattaccctcccaaaggttaccagcgtttgaattta

SEQ ID NO: 7654 - DNA, 50 bp, Homo sapiens
acacactaatgtaaccattttatgaaggttgaagtggatttatgcaggca

SEQ ID NO: 7655 - DNA, 50 bp, Homo sapiens
atcaggagaatgtcaaagaagtcctttatgtggattgcccgagcttctct

SEQ ID NO: 7656 - DNA, 50 bp, Homo sapiens
attgtgccactgttttccagcctgggcaatacagtgagaccctgtctcaa

SEQ ID NO: 7657 - DNA, 50 bp, Homo sapiens
cgtcaaagtcaatcccaaaacagataagccctatgaggatgtcagcatca

SEQ ID NO: 7658 - DNA, 50 bp, Homo sapiens
acgacttgctcaagagtaaagattatactgctctgtacaggaagcttgca

SEQ ID NO: 7659 - DNA, 50 bp, Homo sapiens
tgttgaggaaaggaaaagggcatttgtctaaacatggattctgagttgta

SEQ ID NO: 7660 - DNA, 50 bp, Homo sapiens
gtggatgagtagggagtgggcgagacagggacgagatgagcagggtcaag

SEQ ID NO: 7661 - DNA, 50 bp, Homo sapiens
ggtgttcgtgttagtgccaagattgcttcgttgtagagagagttcgttcc

SEQ ID NO: 7662 - DNA, 50 bp, Homo sapiens
actagagtccaggtaatagtagtggagatatgtggagagacatgataggt

SEQ ID NO: 7663 - DNA, 50 bp, Homo sapiens
ttcctgtgtgagatttctcgccattcctcaattcaacaaatatgcctttt

SEQ ID NO: 7664 - DNA, 50 bp, Homo sapiens
tatactttgatccctcagcaagttgtcctcactgttgtgtgaacctgttt

SEQ ID NO: 7665 - DNA, 50 bp, Homo sapiens
tttcctgaatactttatgacaactgagtttgccgggtagagtggccgttt

SEQ ID NO: 7666 - DNA, 50 bp, Homo sapiens
aaactagaattccggtttcccaaggtggcttatgacaaccagaatccttt

SEQ ID NO: 7667 - DNA, 50 bp, Homo sapiens
ggcttcccgcctgtgcagtcatttgtatgtgttttatatattggagtgtt

SEQ ID NO: 7668 - DNA, 50 bp, Homo sapiens
acaaaatataaggtgtgactttggatcctgactcaaaccaaccagctgtt

SEQ ID NO: 7669 - DNA, 50 bp, Homo sapiens
tcaaaatccgttactctttccacaacaattgagggtaatggtgttcagtt

SEQ ID NO: 7670 - DNA, 50 bp, Homo sapiens
gccattccggcttctctatttgaaaacagttaccatattccccctcagtt

SEQ ID NO: 7671 - DNA, 50 bp, Homo sapiens
atttggtagagacggggtttcaccttattgcccaggccatcatgtatctt

SEQ ID NO: 7672 - DNA, 50 bp, Homo sapiens
tgtcatttgccctttcccccatatatgtagaattgggtctttttcaactt

SEQ ID NO: 7673 - DNA, 50 bp, Homo sapiens
acagggagagactacacacaagccaacctcaatctcatctttatgccatt

SEQ ID NO: 7674 - DNA, 50 bp, Homo sapiens
tcttctttttgatgtgaattactcttgaaatgccggagaagggacaaatt

SEQ ID NO: 7675 - DNA, 50 bp, Homo sapiens
agatagagtcatattctatttagcttgggacatggcaggtactcagttgt

SEQ ID NO: 7676 - DNA, 50 bp, Homo sapiens
agcctttttgggagtgagggtttatatgatgtctgattctgtaatactgt

SEQ ID NO: 7677 - DNA, 50 bp, Homo sapiens
gcagccctgagcctggaatagatactttttggtcttttggttgtagatgt

SEQ ID NO: 7678 - DNA, 50 bp, Homo sapiens
ccctccctatctttttatgggtaatttgattatacacggtgcttgaatgt

SEQ ID NO: 7679 - DNA, 50 bp, Homo sapiens
tatgtcttcttaccccagcacccctaatttaaaatacagatccctgaggt

SEQ ID NO: 7680 - DNA, 50 bp, Homo sapiens
aaaaccttgacagttcatttcaccaagcacctatcaggtatttggcaggt

SEQ ID NO: 7681 - DNA, 50 bp, Homo sapiens
agtgcccatgctgtttcagatgctcttctagctcctggagatacatcagt

SEQ ID NO: 7682 - DNA, 50 bp, Homo sapiens
tgagcttctgctagtaattccttcaggggatttcctccatggccgtaagt

SEQ ID NO: 7683 - DNA, 50 bp, Homo sapiens
gagggtgtctgctaatgatttccgaaaagttcttcaaaacactccgaagt

SEQ ID NO: 7684 - DNA, 50 bp, Homo sapiens
accagtgtgatgagttttgacaagagacaaaaggaaagggtgggagaagt

SEQ ID NO: 7685 - DNA, 50 bp, Homo sapiens
gctggttgttgcctttcaagacagccaactaccatttattcaacagaagt

SEQ ID NO: 7686 - DNA, 50 bp, Homo sapiens
agtctgtctattctcttctctttagctctgtctgttgctcaaattcaagt

SEQ ID NO: 7687 - DNA, 50 bp, Homo sapiens
gccaaggtgagtcaaaacactgctcttcagaaagcaattatttgaaaagt

SEQ ID NO: 7688 - DNA, 50 bp, Homo sapiens
cattgtccctcccgctgtgctctcaggcaataaatgatttgattatttct

SEQ ID NO: 7689 - DNA, 50 bp, Homo sapiens
ggtcagaaacaggcccacagagactctggagggttcttcctttgtgttct

SEQ ID NO: 7690 - DNA, 50 bp, Homo sapiens
ttcaactgctttggcactgccatgggtacctgaggataagagagatgtct

SEQ ID NO: 7691 - DNA, 50 bp, Homo sapiens
gggttgactaaatgcacatgggcttatctttacctcttccagaaatgtct

SEQ ID NO: 7692 - DNA, 50 bp, Homo sapiens
tgcatgaccagaaacactgcctgatacagtaagcagaggtagctgtctct

SEQ ID NO: 7693 - DNA, 50 bp, Homo sapiens
acctgccagccagcccacaactataaactgtgtgacacccaaatttatct

SEQ ID NO: 7694 - DNA, 50 bp, Homo sapiens
ggtttctgaggtgattctaatatgcagtcatggttaagaacctgtgatct

SEQ ID NO: 7695 - DNA, 50 bp, Homo sapiens
aagccttggaccagcttcccgtttctctcttgtctcctgccaaaagatct

SEQ ID NO: 7696 - DNA, 50 bp, Homo sapiens
acccaaaggatggtgtctcctgtcccagttgaaaaggtttctacctagct

SEQ ID NO: 7697 - DNA, 50 bp, Homo sapiens
tggttgaatacgcaggaacacccacagtacccagggactaataaatagct

SEQ ID NO: 7698 - DNA, 50 bp, Homo sapiens
ttagggcagtggagaatcagggtgtatctaataaattccttcatggagct

SEQ ID NO: 7699 - DNA, 50 bp, Homo sapiens
gcagatgtctgcgtcatggtttattactcctgtgttcgtttcaaggagct

SEQ ID NO: 7700 - DNA, 50 bp, Homo sapiens
tgtctgtatttggagtccagtagtacactgaaaataatcccgtaaaagct

SEQ ID NO: 7701 - DNA, 50 bp, Homo sapiens
ctcccttcccaccatacacacactcccagctcattttgattccttttcct

SEQ ID NO: 7702 - DNA, 50 bp, Homo sapiens
ggtgaaattgactgggttcctctcccacctctctttccgtagcaattcct

SEQ ID NO: 7703 - DNA, 50 bp, Homo sapiens
actaattcccgtgtctggccctgaacatgaagatataatggacgatccct

SEQ ID NO: 7704 - DNA, 50 bp, Homo sapiens
ttaaaggctcaaacctacctcagacactgctctacccatccccatcccct

SEQ ID NO: 7705 - DNA, 50 bp, Homo sapiens
ccctttgtgagaagaagcaggtttcctttcctatggattgatgtgaccct

SEQ ID NO: 7706 - DNA, 50 bp, Homo sapiens
ttctacccatcacacagattcttccacttaataaaatccatcacctacct

SEQ ID NO: 7707 - DNA, 50 bp, Homo sapiens
tcattactgttgtgaaggctcttcaagagagaaagatgaagctgaaacct

SEQ ID NO: 7708 - DNA, 50 bp, Homo sapiens
gctgtccgtgaaagcactctcaagtcaggaactgaactaagaactttact

SEQ ID NO: 7709 - DNA, 50 bp, Homo sapiens
ctcctgtaatcccagcactggagcttgcagtgagccaagatcatgccact

SEQ ID NO: 7710 - DNA, 50 bp, Homo sapiens
ttggtcaccacacctgggtgtctgaatgtcttgtccttctaaaggtaact

SEQ ID NO: 7711 - DNA, 50 bp, Homo sapiens
gcaacaattctttggaaagtgactctctagggtgcggagaatggtgtgat

SEQ ID NO: 7712 - DNA, 50 bp, Homo sapiens
tcatctctgtaggtcttcctaatcctatgcggagccaaatatagacggat

SEQ ID NO: 7713 - DNA, 50 bp, Homo sapiens
ctttgtatttcaaagaaagtagccccttggctctgatattagttgcagat

SEQ ID NO: 7714 - DNA, 50 bp, Homo sapiens; identical to SEQ ID NO: 5265

SEQ ID NO: 7715 - DNA, 50 bp, Homo sapiens
actgggatgagatgagattcaaggcacttttggagggtgtagctagccat

SEQ ID NO: 7716 - DNA, 50 bp, Homo sapiens
aggctgttgctgcacgggcttttcaaaagcgactcattatgaagaagaat

SEQ ID NO: 7717 - DNA, 50 bp, Homo sapiens
gcactccagcctgggcaacaagagcgaaactctgcctccaataaataaat

SEQ ID NO: 7718 - DNA, 50 bp, Homo sapiens
cgggcggtggcggctgcctgggagaagatgaatctttcatgagtgatttg

SEQ ID NO: 7719 - DNA, 50 bp, Homo sapiens
gatggaactcaaggtgctttacgctttcctcagtcttaccaggaggcttg

SEQ ID NO: 7720 - DNA, 50 bp, Homo sapiens
accaaccctatggacaacttgatcttgaacttctagctttcagacctgtg

SEQ ID NO: 7721 - DNA, 50 bp, Homo sapiens
aatgtagctgacattggagccaccgcccatagaagaaggctaaaactgtg

SEQ ID NO: 7722 - DNA, 50 bp, Homo sapiens
cttcactgacgatctgagacactaggcaggttggaaagggtggagtggtg

SEQ ID NO: 7723 - DNA, 50 bp, Homo sapiens
gcccctggtggttggaaaagtgttctgaatccaataaaaggaaagcggtg

SEQ ID NO: 7724 - DNA, 50 bp, Homo sapiens
caacagtggcaagagtagccagcccataggacggaatgaaaatcaaggtg

SEQ ID NO: 7725 - DNA, 50 bp, Homo sapiens
catccttagatgccagtcttcactttgggtattttcctgcctcctcagtg

SEQ ID NO: 7726 - DNA, 50 bp, Homo sapiens
accaacagtaccgttattgccaccacaagtaaaccagtccctcacttctg

SEQ ID NO: 7727 - DNA, 50 bp, Homo sapiens
aggctaaatcagagctttcctccccagataaaggaaattttccctccctg

SEQ ID NO: 7728 - DNA, 50 bp, Homo sapiens
aacttccagaggcaggagattagacagggatgacagttaaggggttactg

SEQ ID NO: 7729 - DNA, 50 bp, Homo sapiens
acctcttcgttgtattttacctttcacttacaaacaagctcatgccactg

SEQ ID NO: 7730 - DNA, 50 bp, Homo sapiens
gatcaaaacaaggtccttgactttttgcaggggcagcctggcaatcaatg

SEQ ID NO: 7731 - DNA, 50 bp, Homo sapiens
cctaaatgttgtccctcagagatgcacagatgtatatgggtaaggaaatg

SEQ ID NO: 7732 - DNA, 50 bp, Homo sapiens
ccaaccatagtcatgaagctgcttctgttcccaatgcaatcccattgtgg

SEQ ID NO: 7733 - DNA, 50 bp, Homo sapiens
gcttttcaatgcttccgaaactgagtgctaacaggggcaattagtgctgg

SEQ ID NO: 7734 - DNA, 50 bp, Homo sapiens
agttcttgtaacagttaaaactttcttgccagctctcaggttatcactgg

SEQ ID NO: 7735 - DNA, 50 bp, Homo sapiens
gtgtgtaaatgagtgtcagatcttttcttgaaaacaggtttggattgggg

SEQ ID NO: 7736 - DNA, 50 bp, Homo sapiens
agggtccacaaggagaatattttcttaaagtaactccctgatttgcgggg

SEQ ID NO: 7737 - DNA, 50 bp, Homo sapiens
gctcccctatgcctgtgtagcagaatctaaaagataatcatgtgaacggg

SEQ ID NO: 7738 - DNA, 50 bp, Homo sapiens
ttgtcttgtttcttttatctcccctatgtttcatcttagtgcaggcaggg

SEQ ID NO: 7739 - DNA, 50 bp, Homo sapiens
acagttgcctttgagattcctgtatttctgcatgaataaatccataaggg

SEQ ID NO: 7740 - DNA, 50 bp, Homo sapiens
gtccttggaaggtaacacttgtgattggaaccactcttcaagctgaacgg

SEQ ID NO: 7741 - DNA, 50 bp, Homo sapiens
attcattcattcattcaacaagcacttaaaaacaatgcctgtgtgccagg

SEQ ID NO: 7742 - DNA, 50 bp, Homo sapiens
cacacccagccccattcacaaaggactataaaatctacaccccagtcacg

SEQ ID NO: 7743 - DNA, 50 bp, Homo sapiens
ggcatagtagtgctaaacagaggtggaagtagtgaagggagttttgaacg

SEQ ID NO: 7744 - DNA, 50 bp, Homo sapiens
ctagtcctgcccccacctccccaagtattacccctcctaagtcctgctag

SEQ ID NO: 7745 - DNA, 50 bp, Homo sapiens
agataagcaggataaacaagacaggttggattgtgatcagctctatggag

SEQ ID NO: 7746 - DNA, 50 bp, Homo sapiens
gatggctaggacaagatgatttacaagagcgtggcgggagggacggcgag

SEQ ID NO: 7747 - DNA, 50 bp, Homo sapiens
ccgtgtctggattgtgtgtcttacttctaaaggtgcacatacttcataag

SEQ ID NO: 7748 - DNA, 50 bp, Homo sapiens
gtatctctgcacctcactactacccttcactccttggagacctgggcaag

SEQ ID NO: 7749 - DNA, 50 bp, Homo sapiens
aacacaccaccaaacattcttcccatccttcttcaccaaccagctacaag

SEQ ID NO: 7750 - DNA, 50 bp, Homo sapiens
acaattggagttggggctgtcaccacctgaagtgtgtcaaccacagaaag

SEQ ID NO: 7751 - DNA, 50 bp, Homo sapiens
ttagggcaaaagtcctagtggcggcagctttcttgtctagaccctggttc

SEQ ID NO: 7752 - DNA, 50 bp, Homo sapiens
agtgatgcttgccttttcgctttcctaaagatgtcatttgaaaacaagtc

SEQ ID NO: 7753 - DNA, 50 bp, Homo sapiens
cccagcttcattaatgtgaatggtggcagacacctctagctatagagctc

SEQ ID NO: 7754 - DNA, 50 bp, Homo sapiens
gagccaagattgggccactgcactccagcctgggtgacagagtgagactc

SEQ ID NO: 7755 - DNA, 50 bp, Homo sapiens
gagccgagattgcatcactgcactccagcctggtcaacagagcgagactc

SEQ ID NO: 7756 - DNA, 50 bp, Homo sapiens
ttcagtcatgcagcaacatccgcttaatgcctcctaagtgcagaacactc

SEQ ID NO: 7757 - DNA, 50 bp, Homo sapiens
ggtcctcttctctctactctccctagtaactaaccaccaaagcctaaatc

SEQ ID NO: 7758 - DNA, 50 bp, Homo sapiens
ttgtttgtttgtttatttatttattttgaggcagcgtcttgctctgttgc

SEQ ID NO: 7759 - DNA, 50 bp, Homo sapiens
tgccatctttacatctaatcaagaggtagagcttcccctggtgttcctgc

SEQ ID NO: 7760 - DNA, 50 bp, Homo sapiens
tgctctgctcttcccaaatcaaggaatgtagatcttgctaacagaactgc

SEQ ID NO: 7761 - DNA, 50 bp, Homo sapiens
tggcaccaacttacacttccagaagagagtggttcaggaaattactatgc

SEQ ID NO: 7762 - DNA, 50 bp, Homo sapiens
aactttgggaagtgagactctgtcttgggtttttgataataaatgtgggc

SEQ ID NO: 7763 - DNA, 50 bp, Homo sapiens
ccgagaaagtacggctggagcggactggggagacggaaatattgagtcgc

SEQ ID NO: 7764 - DNA, 50 bp, Homo sapiens
cgaagaaagaattggatgcagaattgttgcctaacctgggtgacaagagc

SEQ ID NO: 7765 - DNA, 50 bp, Homo sapiens
agtgcctgtgattccacccccttacctcccactcaagtgacaatgtaagc

SEQ ID NO: 7766 - DNA, 50 bp, Homo sapiens
agaaagttaggagtcggcaaccttaaggaggagtttcctatcatctctcc

SEQ ID NO: 7767 - DNA, 50 bp, Homo sapiens
tgtcacaaagatgaagcaaggtggctcagggaacgtgctcagaaacctcc

SEQ ID NO: 7768 - DNA, 50 bp, Homo sapiens
gcaaagtgaaagttttccctttggccctaaaatatgaaagcaaagcatcc

SEQ ID NO: 7769 - DNA, 50 bp, Homo sapiens
ccctgtccatcttttcctgttcctatccagccttccctctcctttttgcc

SEQ ID NO: 7770 - DNA, 50 bp, Homo sapiens
ccacggagggctccccatctaaagggagtttaataaacaaaggaatggcc

SEQ ID NO: 7771 - DNA, 50 bp, Homo sapiens
caattggtacattctcggcaaacccttgcccacaatttcctcaggaagcc

SEQ ID NO: 7772 - DNA, 50 bp, Homo sapiens
agggtgtccctgtgatttttaaattcactatctagctgtccctatccccc

SEQ ID NO: 7773 - DNA, 50 bp, Homo sapiens
cttatattatgttttctctgtgacaagcacctcacctcccaacccacccc

SEQ ID NO: 7774 - DNA, 50 bp, Homo sapiens
gagaattcaaattaaatgcagagtcctaggcccaccctggcataccaccc

SEQ ID NO: 7775 - DNA, 50 bp, Homo sapiens
acaaccaatgcctcacacttaagctcctagaagtcactagggaccagacc

SEQ ID NO: 7776 - DNA, 50 bp, Homo sapiens
gccctcaccagaattcaatcatgctggcaccttatcttggactttcaacc

SEQ ID NO: 7777 - DNA, 50 bp, Homo sapiens
agggtaagagttccagacctgactggacaataaagtgagactgtctctac

SEQ ID NO: 7778 - DNA, 50 bp, Homo sapiens
ctccgtctgccgcctccgtagccacagcgactttggaagtgatatttgac

SEQ ID NO: 7779 - DNA, 50 bp, Homo sapiens
ccctggagaaggagggtgatttattttcaactttctgatttaccaccgac

SEQ ID NO: 7780 - DNA, 50 bp, Homo sapiens
gattgtttgagcctgggagttccacaccagcctgggctacatagggagac

SEQ ID NO: 7781 - DNA, 50 bp, Homo sapiens
ctgctctagactgagcacagccactgacaggtgaccttcagaatcctcac

SEQ ID NO: 7782 - DNA, 50 bp, Homo sapiens
acccctgctttactgtgacagacatatagtttgtcatacataaaacccac

SEQ ID NO: 7783 - DNA, 50 bp, Homo sapiens
acctaacagaaatttggattcgggttgtctaaatacaccctggtgggtta

SEQ ID NO: 7784 - DNA, 50 bp, Homo sapiens
gcctttcccaccaacagtttatgtgattccctgccctacccttaccatta

SEQ ID NO: 7785 - DNA, 50 bp, Homo sapiens
tcccattgcatgtcccgtatattgaaagctgcctctacttctctctggta

SEQ ID NO: 7786 - DNA, 50 bp, Homo sapiens
ggcaggggatgaaccagataatttccagcccttcttggtagctcttcgta

SEQ ID NO: 7787 - DNA, 50 bp, Homo sapiens
gcttaggagtttgggaccagcctgggtaacatagtgaaaccctgtctcta

SEQ ID NO: 7788 - DNA, 50 bp, Homo sapiens
ttgcagctattttcaagttgtaagaaatgaacttgcaacacatagggcta

SEQ ID NO: 7789 - DNA, 50 bp, Homo sapiens
tctcttgccacagggatttcctccaagctggaatcaccatttccttccta

SEQ ID NO: 7790 - DNA, 50 bp, Homo sapiens
cccacccaccagtaggttgtgattcaactgaaccatttcaggagcaccta

SEQ ID NO: 7791 - DNA, 50 bp, Homo sapiens
gaacccagctaagccacacccagattctgacccagggatactctgaaata

SEQ ID NO: 7792 - DNA, 50 bp, Homo sapiens
gtgtgtgctggcgtgccttataggtgtgcgtgtttccctgtcagttttga

SEQ ID NO: 7793 - DNA, 50 bp, Homo sapiens
aggaaaactcagaaataatttctgccccctggattctctaagatttgtga

SEQ ID NO: 7794 - DNA, 50 bp, Homo sapiens
gtggaaagaatcctacaacgaacactattaaagtctgcacctagatctga

SEQ ID NO: 7795 - DNA, 50 bp, Homo sapiens
ggcctaggttccagcattcagtcatcaagtcttgttacagaaataaatga

SEQ ID NO: 7796 - DNA, 50 bp, Homo sapiens
ccccatttggagtctagtcaaaacagcagcttctttgagttaccattgga

SEQ ID NO: 7797 - DNA, 50 bp, Homo sapiens
aaggcttgtaactgtaggcccttgtactacactgtgctatacctggtaga

SEQ ID NO: 7798 - DNA, 50 bp, Homo sapiens
cactttgggaggcagaggtgagcagatcacttgaggccaggagtttgaga

SEQ ID NO: 7799 - DNA, 50 bp, Homo sapiens
ggatcacttgaagccagcagtttgagaccagcctgggcaataaaatgaga

SEQ ID NO: 7800 - DNA, 50 bp, Homo sapiens
tcagttgtgatgggatttcttgatggatgagatgtgtcgtgtgacagaga

SEQ ID NO: 7801 - DNA, 50 bp, Homo sapiens
cctcctagaactggaaccaagactgctccatcagagttaaaggtgtaaga

SEQ ID NO: 7802 - DNA, 50 bp, Homo sapiens
gctcacccttgcacctccttcccaaatctgctgtcacattttctcaaaga

SEQ ID NO: 7803 - DNA, 50 bp, Homo sapiens
ttcctgtctccatgttgtggtcaagattgccatttgcttcctgagtttca

SEQ ID NO: 7804 - DNA, 50 bp, Homo sapiens
ctggttctagtgcagtctcctcactttcctggtgtttggtttatctttca

SEQ ID NO: 7805 - DNA, 50 bp, Homo sapiens
tgacatgattacctgactgatgtttctcctccattagactgaatgcttca

SEQ ID NO: 7806 - DNA, 50 bp, Homo sapiens
tggcaaaaagcctaacactgactcatcccattctatcagcacaaacttca

SEQ ID NO: 7807 - DNA, 50 bp, Homo sapiens
gtttacaagggatactagttcctggagggacgaaggaggctctgtttgca

SEQ ID NO: 7808 - DNA, 50 bp, Homo sapiens
tcctcaactcggagattcctgtatggagagaatcaatttctatatttgca

SEQ ID NO: 7809 - DNA, 50 bp, Homo sapiens
acatttcttaggtgtgtagtggtgaaggaaaatagtggaagatgtctgca

SEQ ID NO: 7810 - DNA, 50 bp, Homo sapiens
tcaggaggcttgaaaagactcaaggtttctacactatgggaaataaggca

SEQ ID NO: 7811 - DNA, 50 bp, Homo sapiens
gttttcacttgtgatactaactattgtttttctcccccatgccaagagca

SEQ ID NO: 7812 - DNA, 50 bp, Homo sapiens
agccaagggagcatattattctcttattttaaacctctccgtaggcagca

SEQ ID NO: 7813 - DNA, 50 bp, Homo sapiens
agaaggacccctggttgagaaccacggttgtatagaaaggaattgaagca

SEQ ID NO: 7814 - DNA, 50 bp, Homo sapiens
ttgactgccatagccaagagttaatatagttgcgttttcttaaggaagca

SEQ ID NO: 7815 - DNA, 50 bp, Homo sapiens
cttactgtgcttttaggttttgttgctttctgtctgtatgctatgttcca

SEQ ID NO: 7816 - DNA, 50 bp, Homo sapiens
tgcagttaggagtgtggacactctgcccatctccattgaattaaattcca

SEQ ID NO: 7817 - DNA, 50 bp, Homo sapiens
acttgggttctatccccacgataacttgttatgtatatgccaatatccca

SEQ ID NO: 7818 - DNA, 50 bp, Homo sapiens
agctagaaaatgtccctttttcttctttggaggtctttaaccaaggccca

SEQ ID NO: 7819 - DNA, 50 bp, Homo sapiens
atcaccaatcttatttagcactgtggatgccgttttgcaaatgtcaccca

SEQ ID NO: 7820 - DNA, 50 bp, Homo sapiens
tgacttaaggttggaatatctcctactactcccctgtcctccttggacca

SEQ ID NO: 7821 - DNA, 50 bp, Homo sapiens
tgtggtttgcaatggtttactgatgagacagcaaaaatgagacaggacca

SEQ ID NO: 7822 - DNA, 50 bp, Homo sapiens
tggcgagccagtctctggatgggattctgatcaacagaagttctcataca

SEQ ID NO: 7823 - DNA, 50 bp, Homo sapiens
tgcccatcctttgctgtttttctctttcagtcatggcctatttggagaca

SEQ ID NO: 7824 - DNA, 50 bp, Homo sapiens
ctcaaccttggccctaaactaacagtgacagggagttccccagcctcaca

SEQ ID NO: 7825 - DNA, 50 bp, Homo sapiens
tcctgaccgttgacagagagcttttacagaagtcttaggcagtacacaca

SEQ ID NO: 7826 - DNA, 50 bp, Homo sapiens
agtgtgtggcacccagggatcactgtatgagaatttcctgaacaacaaca

SEQ ID NO: 7827 - DNA, 50 bp, Homo sapiens
gctgtaagtcccttccttactcatcttccctctcaaatacaacaacaaca

SEQ ID NO: 7828 - DNA, 50 bp, Homo sapiens
gccagttggcaccatttatgaaacacaccaccttgtaaccactgaattaa

SEQ ID NO: 7829 - DNA, 50 bp, Homo sapiens
tcaacctagcacagtgcctggctgataggtgttgaatatttccactctaa

SEQ ID NO: 7830 - DNA, 50 bp, Homo sapiens
gcaaccctctgcccctgcaaagagatattgtgacaaagatattcactgaa

SEQ ID NO: 7831 - DNA, 50 bp, Homo sapiens
taacattcctggcacagtccctggcatagggtagataataaatggtggaa

SEQ ID NO: 7832 - DNA, 50 bp, Homo sapiens
tctctaaccatcaaggaaggtcaagggccatgtatctcttttagggagaa

SEQ ID NO: 7833 - DNA, 50 bp, Homo sapiens
ttccacaaactcaggtgtgcaagaaacaatgcattactttattttcagaa

SEQ ID NO: 7834 - DNA, 50 bp, Homo sapiens
caggagtttgagaccagcctgggcaacatagtaagtctccatctcttcaa

SEQ ID NO: 7835 - DNA, 50 bp, Homo sapiens
tccctagtcctggagactcgggaactaaaacaatcaattcccctgagcaa

SEQ ID NO: 7836 - DNA, 50 bp, Homo sapiens
tcctcttcattggagacccctccctgtcacagcacaatgtgggtaataaa

SEQ ID NO: 7837 - DNA, 50 bp, Homo sapiens
cagaacaaggcccacagtgtgaaaggtgctgctgaacaaagataaataaa

SEQ ID NO: 7838 - DNA, 50 bp, Homo sapiens
gagtcagcaacactggtcctcttgccttggttgatgcttttgaactgaaa

SEQ ID NO: 7839 - DNA, 50 bp, Homo sapiens
taaggatgtatccctatgggcaggaaacccaattctaagaaacttacaaa

SEQ ID NO: 7840 - DNA, 50 bp, Homo sapiens
gccactgcactccagcctgggcaacagagcgagaccttgactctttaaaa

SEQ ID NO: 7841 - DNA, 50 bp, Homo sapiens
cacaacacccaaaaggctgcattgcataacatgtatttgttgaatgaaaa

SEQ ID NO: 7842 - DNA, 50 bp, Homo sapiens
ggggtccttgctcacagagctcccaagatggtggtgggccacttccaaaa

SEQ ID NO: 7843 - DNA, 50 bp, Homo sapiens
tccctctataggtaaaagacctgtttgtctgaaatgtgtggaacctgtct

SEQ ID NO: 7844 - DNA, 50 bp, Homo sapiens
gctgccgtgtcttttggcattttcagcatgactatatgtttttgtaatgt

SEQ ID NO: 7845 - DNA, 50 bp, Homo sapiens
ccgaaggcccgtgtggcgcttctcctattctgtagagtggtagtttgttt

SEQ ID NO: 7846 - DNA, 50 bp, Homo sapiens
aaagaggtaaacgcaagttctctcttgtaggtcgggctacaggtgacttt

SEQ ID NO: 7847 - DNA, 50 bp, Homo sapiens
tggttctcagcctgggtgaacagagaaggggtctaatttggtcttttgtt

SEQ ID NO: 7848 - DNA, 50 bp, Homo sapiens
tgttcttggcaccctgcactgtcaggctatatcatttctgtttgtttctt

SEQ ID NO: 7849 - DNA, 50 bp, Homo sapiens
tctcattttcttttcctagctgtgatgcaaagtgtcagtggtcccatctt

SEQ ID NO: 7850 - DNA, 50 bp, Homo sapiens
tgtccaaccttccttttgctacaaacaaagaatgcctagggattcaactt

SEQ ID NO: 7851 - DNA, 50 bp, Homo sapiens
caagtggccttggtgtttaaatcttgccctaaattgtaactcacatgatt

SEQ ID NO: 7852 - DNA, 50 bp, Homo sapiens
accaaccagtggtgtgctggagctgtctcatactatcttgagagtccatt

SEQ ID NO: 7853 - DNA, 50 bp, Homo sapiens
agcacttgctttgttccagacattgtccttagctcctttcttgtgtaatt

SEQ ID NO: 7854 - DNA, 50 bp, Homo sapiens
tgcagcaaaaattgaatttcataggccattcagtgttctctgcgataatt

SEQ ID NO: 7855 - DNA, 50 bp, Homo sapiens
ccaggaatggaaatacgccaacccaggttaggcacctctattgcagaatt

SEQ ID NO: 7856 - DNA, 50 bp, Homo sapiens
aggaaattggttgaagtcgtttttctcttgttagtctcatgttaagctgt

SEQ ID NO: 7857 - DNA, 50 bp, Homo sapiens
tcgcctggggagaatttaaaatctaagtcgctggaagtccctttgtatgt

SEQ ID NO: 7858 - DNA, 50 bp, Homo sapiens
acctgtaggaagggtttgtgaatattctgttgctctgaattattagcggt

SEQ ID NO: 7859 - DNA, 50 bp, Homo sapiens
tgagaggatcttgagacattcttgtgttatttgccctctatgttttaggt

SEQ ID NO: 7860 - DNA, 50 bp, Homo sapiens
tcccaagcatgagacaagtaccaccagtggttcaggagatgattttaggt

SEQ ID NO: 7861 - DNA, 50 bp, Homo sapiens
acaagacagcagccttcccgaaatgtcactactaagaattattcagaggt

SEQ ID NO: 7862 - DNA, 50 bp, Homo sapiens
gctgcccaaacttccatttatttaccctccaaacatcacttccttcctct

SEQ ID NO: 7863 - DNA, 50 bp, Homo sapiens
acatttgccaatgcacttgatgtaaagttgttgaggatgttgactctcct

SEQ ID NO: 7864 - DNA, 50 bp, Homo sapiens
tcccccttcctaacaccaatttgggaacatcactacttgtatattatcct

SEQ ID NO: 7865 - DNA, 50 bp, Homo sapiens
tcaagacccttagagtaagttaactcccaaggaaatgtagttagttccct

SEQ ID NO: 7866 - DNA, 50 bp, Homo sapiens
aacccacaatccaactcccttgatgaggatgatcattaacaacaatcact

SEQ ID NO: 7867 - DNA, 50 bp, Homo sapiens
tttgaagcctctggtacttccccttcccaaacccagtcacaggaaacact

SEQ ID NO: 7868 - DNA, 50 bp, Homo sapiens
ttggaggttaacagtattcctttgagtggtgtgattaaaggtgcttttat

SEQ ID NO: 7869 - DNA, 50 bp, Homo sapiens
ccaacctccagaactgcctatctaactcatctgtggtgatggaatgctat

SEQ ID NO: 7870 - DNA, 50 bp, Homo sapiens
agtggctctctgctgttagcatggttactaatcttttggttacttttcat

SEQ ID NO: 7871 - DNA, 50 bp, Homo sapiens
tgacctcagtgtctacttcagcagaacctgtgggtatatgcctacctcat

SEQ ID NO: 7872 - DNA, 50 bp, Homo sapiens
aaggagaactgtcaactgaatctcaaatgcagtcaaatgaagagaggcat

SEQ ID NO: 7873 - DNA, 50 bp, Homo sapiens
ttcaagtcattataggtttgggcatacagggttaaccttgtgatgtacat

SEQ ID NO: 7874 - DNA, 50 bp, Homo sapiens
agcagaacaacatgtgtttgacacttttccttctctgtaatgaggtacat

SEQ ID NO: 7875 - DNA, 50 bp, Homo sapiens
tgcctgtgtgggtcaaaggaatcatctatgctaatgtatttgagccaaat

SEQ ID NO: 7876 - DNA, 50 bp, Homo sapiens
accgaaagcagcattttcaatgtttaattaaatcgatgcaggaaattgtg

SEQ ID NO: 7877 - DNA, 50 bp, Homo sapiens
gtccctggcccttcactcttcgtccaggctctctgacctctttccctctg

SEQ ID NO: 7878 - DNA, 50 bp, Homo sapiens
tgtccgctgttttacctcactgctcctgtttatgcccttaacttctgctg

SEQ ID NO: 7879 - DNA, 50 bp, Homo sapiens
gcacaagacctcacttggaacaagtaccaggcagaagagagcattacctg

SEQ ID NO: 7880 - DNA, 50 bp, Homo sapiens
tttcatatcttggcagttggatgcggtaagagccacagagaaaccacctg

SEQ ID NO: 7881 - DNA, 50 bp, Homo sapiens
aggacccttttcccatatttctggctatatacaaggatatccagacactg

SEQ ID NO: 7882 - DNA, 50 bp, Homo sapiens
accaggcctagaatttaggttctaggtgtaaactattggcctatcagatg

SEQ ID NO: 7883 - DNA, 50 bp, Homo sapiens
gtgcattttagcaacagacttccaggtttccagcgcgggccaggaagggg

SEQ ID NO: 7884 - DNA, 50 bp, Homo sapiens
ctgtcatgcaccacctcatcccctccttcagggccagggacagtccctag

SEQ ID NO: 7885 - DNA, 50 bp, Homo sapiens
agaggaggagggggtagaatgaatttcatttaaagctcaacctagttcag

SEQ ID NO: 7886 - DNA, 50 bp, Homo sapiens
cagtctcccagctttcttggcctcctctgccaactggatgcaaggctcag

SEQ ID NO: 7887 - DNA, 50 bp, Homo sapiens
tggagagaaggttcgggaagacgagggggctgggaggtttggaaagacag

SEQ ID NO: 7888 - DNA, 50 bp, Homo sapiens
ctgaaatgggggaaggtgggttatgacaaagttcatggagaggcctgaag

SEQ ID NO: 7889 - DNA, 50 bp, Homo sapiens
taaagcggtacgggattccgcaccctactccagcaagaaagagcctgaag

SEQ ID NO: 7890 - DNA, 50 bp, Homo sapiens
agcattcattcctccaaacacactcccagggttaggtctcttacctctgc

SEQ ID NO: 7891 - DNA, 50 bp, Homo sapiens
ggtgttgaatatttatacggattggcatcataagataccgcgatacctgc

SEQ ID NO: 7892 - DNA, 50 bp, Homo sapiens
accttagtctaactgccttctgtaaagtgggttgctatagtctttaagcc

SEQ ID NO: 7893 - DNA, 50 bp, Homo sapiens
tgaggtttggatggtggcaggtaaaacagaaaggcaagatgtcatctgac

SEQ ID NO: 7894 - DNA, 50 bp, Homo sapiens
tggagctgctacataattatttcaggtctcaaagcttccaagaagtggac

SEQ ID NO: 7895 - DNA, 50 bp, Homo sapiens
agacggaacctgagatgttggatgttgttgatcttagcaaacagacttta

SEQ ID NO: 7896 - DNA, 50 bp, Homo sapiens
agatctgtaatctttggcaaatggaactcacctgcaacgatacctactta

SEQ ID NO: 7897 - DNA, 50 bp, Homo sapiens
gaggacttccattccccatttcccgcatacctgctgttctgtctgaatta

SEQ ID NO: 7898 - DNA, 50 bp, Homo sapiens
agctcacacctgttccttcatgggtcagttcctttcattttcacttttga

SEQ ID NO: 7899 - DNA, 50 bp, Homo sapiens
agctgctgcttctctttcagttgcaaatgcaaacctgttataatctttga

SEQ ID NO: 7900 - DNA, 50 bp, Homo sapiens
tcaatatctgtgtgtcttttcatgagtggctgttacttgtgaagaattga

SEQ ID NO: 7901 - DNA, 50 bp, Homo sapiens
tgagtggactgaggaatgaatagaaaacgtggatatatgtagaaagctga

SEQ ID NO: 7902 - DNA, 50 bp, Homo sapiens
accagcccctgggaatgttatgagcaaatgatactccatgagtaaaatga

SEQ ID NO: 7903 - DNA, 50 bp, Homo sapiens
tcgtgtgagtgtgagagacatgttcattgtgaaaagatactcctagtgga

SEQ ID NO: 7904 - DNA, 50 bp, Homo sapiens
tttgtcaaatgcctgttcaccatctgtggaagtcattatatgattcagga

SEQ ID NO: 7905 - DNA, 50 bp, Homo sapiens
acacttttcttctaaggagagctttcttaggcatttcaaagaactttcga

SEQ ID NO: 7906 - DNA, 50 bp, Homo sapiens
accaaatgagtaccatctgttgaacacagggtggcgatccaagtgtttca

SEQ ID NO: 7907 - DNA, 50 bp, Homo sapiens
acctgacttccacgataaaatggagatgagtgcaggggtgagtgtatagt

SEQ ID NO: 7908 - DNA, 50 bp, Homo sapiens
tgcagatttatactcctgacgtgtctcattcacagctaaataataggcca

SEQ ID NO: 7909 - DNA, 50 bp, Homo sapiens
accctcgccctttccctccggttcagtacctattgtttctcctttcaaat

SEQ ID NO: 7910 - DNA, 50 bp, Homo sapiens
aagaggaaatggcagaattaaaagcagaaacaagaagatggacatggatt

SEQ ID NO: 7911 - DNA, 50 bp, Homo sapiens
aagagtgtttgagtgcttgtcatcaggtgttttccttaataagtagggat

SEQ ID NO: 7912 - DNA, 50 bp, Homo sapiens; identical to SEQ ID NO: 2584

SEQ ID NO: 7913 - DNA, 50 bp, Homo sapiens
ttccttggattcatttcacttggctagaaattacactgtgctcaatgcct

SEQ ID NO: 7914 - DNA, 50 bp, Homo sapiens
aggtctctgccacctccttctctgtgagctgtcagtctaggttattctct

SEQ ID NO: 7915 - DNA, 50 bp, Homo sapiens
gaataggagggacatggaaccatttgcctctggctgtgtcacagggtgag

SEQ ID NO: 7916 - DNA, 50 bp, Homo sapiens; identical to SEQ ID NO: 507

SEQ ID NO: 7917 - DNA, 50 bp, Homo sapiens
tttcactttcacacttcatctcattcctgttgtcactttccccgaaacga

SEQ ID NO: 7918 - DNA, 50 bp, Homo sapiens
tctggatcaatagcttcccctctagggtctactgatgagtcaaatctaaa

SEQ ID NO: 7919 - DNA, 50 bp, Homo sapiens
tttatctactgtgtgttgtggtggcctgttggaggcaaatagatcagatt

SEQ ID NO: 7920 - DNA, 50 bp, Homo sapiens
gacatttttgtaggatgcctgacgaggtgtagccttttatcttgtttccg

SEQ ID NO: 7921 - DNA, 50 bp, Homo sapiens
cccagtttgtggaagcacaggcaagagtgttcttttctggtgattctcca

SEQ ID NO: 7922 - DNA, 50 bp, Homo sapiens
tgttccttttcctgactcctccttgcaaacaaaatgatagttgacacttt

SEQ ID NO: 7923 - DNA, 50 bp, Homo sapiens
gtgacttgtacattcagcaatagcatttgagcaagttttatcagcaagca

SEQ ID NO: 7924 - DNA, 50 bp, Homo sapiens
ttgctatcgacattcccgtataaagagagagacatatcacgctgctgtca

SEQ ID NO: 7925 - DNA, 50 bp, Homo sapiens; identical to SEQ ID NO: 618

SEQ ID NO: 7926 - DNA, 50 bp, Homo sapiens; identical to SEQ ID NO: 7197

SEQ ID NO: 7927 - DNA, 50 bp, Homo sapiens; identical to SEQ ID NO: 619

SEQ ID NO: 7928 - DNA, 50 bp, Homo sapiens
tgtgattaggttgttttcctgtcatttttgagagactaaaattgtggggg

SEQ ID NO: 7929 - DNA, 50 bp, Homo sapiens; identical to SEQ ID NO: 7260

SEQ ID NO: 7930 - DNA, 50 bp, Homo sapiens
aacaagatgagaacagataaagattgtgtggtgttttggatttggagaga

SEQ ID NO: 7931 - DNA, 50 bp, Homo sapiens
tgtagctcccacaaggtaaacttcattggtaagattgcactgttctgatt

SEQ ID NO: 7932 - DNA, 50 bp, Homo sapiens
tcactcccccatttcacttctttgtcagagaatagttcttgttcatactg

SEQ ID NO: 7933 - DNA, 50 bp, Homo sapiens
tgggagtgacaaacattctctcatcctacttagcctacctagatttctca

SEQ ID NO: 7934 - DNA, 50 bp, Homo sapiens; identical to SEQ ID NO: 648

SEQ ID NO: 7935 - DNA, 50 bp, Homo sapiens
ccccagcctaaagcagggatcagtcttttcttgtggaataaatccttgga

SEQ ID NO: 7936 - DNA, 50 bp, Homo sapiens
tgtggtaatgcctgttttcatctgtaaatagttaagtatgtacacgaggc

SEQ ID NO: 7937 - DNA, 50 bp, Homo sapiens
agatgcttagtccctcatgcaaatcaattactggtccaaaagattgctga

SEQ ID NO: 7938 - DNA, 50 bp, Homo sapiens
aaaactgctcttctgctctagtaccatgcttagtgcaaatgattatttct

SEQ ID NO: 7939 - DNA, 50 bp, Homo sapiens
agctattaggatcttcaacccaggtaacaggaataattctgtggtttcat

SEQ ID NO: 7940 - DNA, 50 bp, Homo sapiens
tcctgcgtctatccatgtggaatgctggacaataaagcgagtgctgccca

SEQ ID NO: 7941 - DNA, 50 bp, Homo sapiens; identical to SEQ ID NO: 4805

SEQ ID NO: 7942 - DNA, 50 bp, Homo sapiens
actgctttgactggtgggtctctagaagcaaaactgagtgataactcatg

SEQ ID NO: 7943 - DNA, 50 bp, Homo sapiens
ggcattgtctctgtttcccagtggggtggacagtatatcagatggtcaga

SEQ ID NO: 7944 - DNA, 50 bp, Homo sapiens
ccctgggctaccatctgcatggggctggggtcctcctgtgctatttgtac

SEQ ID NO: 7945 - DNA, 50 bp, Homo sapiens; identical to SEQ ID NO: 727

SEQ ID NO: 7946 - DNA, 50 bp, Homo sapiens
tcttggcagccatcctttttaagagtaagttggttacttcaaaaagagca

SEQ ID NO: 7947 - DNA, 50 bp, Homo sapiens
agctaaagagagggaacctcatctaagtaacatttgcacatgatacagca

SEQ ID NO: 7948 - DNA, 50 bp, Homo sapiens
gctgagtgctggccctctgcgtcttccttattaaccttgaatcctcatta

SEQ ID NO: 7949 - DNA, 50 bp, Homo sapiens; identical to SEQ ID NO: 768

SEQ ID NO: 7950 - DNA, 50 bp, Homo sapiens
tccgggccaagaatttttatccatgaagactttcctacttttctcggtgt

SEQ ID NO: 7951 - DNA, 50 bp, Homo sapiens
gcagagttcattgttgccccttaacagtttttcctgagtttactgaagaa

SEQ ID NO: 7952 - DNA, 50 bp, Homo sapiens
ttatcaagcagagacctttgttgggaggcggtttgggagaacacatttct

SEQ ID NO: 7953 - DNA, 50 bp, Homo sapiens
gggtatgctgcctctgtaaattcatgtattcaaaggaaaagacaccttgc

SEQ ID NO: 7954 - DNA, 50 bp, Homo sapiens
ttgtctgccccacaatcaagaatgtatgtgtaaagtgtgaataaatctca

SEQ ID NO: 7955 - DNA, 50 bp, Homo sapiens; identical to SEQ ID NO: 2677

SEQ ID NO: 7956 - DNA, 50 bp, Homo sapiens
agcagtttgtgatatagcagaggtttaaatgtaccctccccttttatgca

SEQ ID NO: 7957 - DNA, 50 bp, Homo sapiens
tgatgctgcccattccactgaagttctgaaatctttcgtcatgtaaataa

SEQ ID NO: 7958 - DNA, 50 bp, Homo sapiens; identical to SEQ ID NO: 2256

SEQ ID NO: 7959 - DNA, 50 bp, Homo sapiens; identical to SEQ ID NO: 864

SEQ ID NO: 7960 - DNA, 50 bp, Homo sapiens
gccaggctggttccgcatggtgatctccgtcttgtatgtctgaatgttgg

SEQ ID NO: 7961 - DNA, 50 bp, Homo sapiens
ctatttccaaggcccctccctgtttccccagcaattaaaacggactcatc

SEQ ID NO: 7962 - DNA, 50 bp, Homo sapiens
aaagtgccagaatgactcttctgtgcattcttcttaaagagctgcttggt

SEQ ID NO: 7963 - DNA, 50 bp, Homo sapiens; identical to SEQ ID NO: 7644

SEQ ID NO: 7964 - DNA, 50 bp, Homo sapiens
agtcctgtatcatccatacttgtactaccttgtcctatgaagctctgaga

SEQ ID NO: 7965 - DNA, 50 bp, Homo sapiens
ttggccgcttccctacccacagggcctgacttttacagcttttctctttt

SEQ ID NO: 7966 - DNA, 50 bp, Homo sapiens
tatgacacagcagctcctttgtaagtaccaggtcatgtccatcccttggt

SEQ ID NO: 7967 - DNA, 50 bp, Homo sapiens; identical to SEQ ID NO: 1204

SEQ ID NO: 7968 - DNA, 50 bp, Homo sapiens
tgcatagatgacctttggattattggactctgactattgggaccctaaat

SEQ ID NO: 7969 - DNA, 50 bp, Homo sapiens
tggacgccctaagaaacagagaaaacagaaataacaaccaggaactgctt

SEQ ID NO: 7970 - DNA, 50 bp, Homo sapiens
caatagcttgtgggtctgtgaagactgcggtgtttgagtttctcacaccc

SEQ ID NO: 7971 - DNA, 50 bp, Homo sapiens
tgcactgtactctcttcataggattgtaaaggtgttctaatccaattgca

SEQ ID NO: 7972 - DNA, 50 bp, Homo sapiens
tgaagtcatttcattgggaaggaaagctgcaaagattattgggggactag

SEQ ID NO: 7973 - DNA, 50 bp, Homo sapiens
tttcatctggcccaccctccttagactctcctcccttcaagagttggagc

SEQ ID NO: 7974 - DNA, 50 bp, Homo sapiens
gtgtagaattcggatccagtcatctcacagaactttccactagggtgcca

SEQ ID NO: 7975 - DNA, 50 bp, Homo sapiens
cggaccccagtttcttgtaccaagggggaaacatgcggggaccccaatgg

SEQ ID NO: 7976 - DNA, 50 bp, Homo sapiens; identical to SEQ ID NO: 1511

SEQ ID NO: 7977 - DNA, 50 bp, Homo sapiens
aacacaacactaaaaccgaacacacacgtactaacacacccacgacccaa

SEQ ID NO: 7978 - DNA, 50 bp, Homo sapiens
ccttctggttctgcttttgaccagcatttttgtgcccctctgttactgtg

SEQ ID NO: 7979 - DNA, 50 bp, Homo sapiens
gatatacgaaacacaccactggacgatgcgaaaaacgagacgacataagc

SEQ ID NO: 7980 - DNA, 50 bp, Homo sapiens
tggacaggcatgaaaggttacaaatgggagaaaactcacacacgttatgt

SEQ ID NO: 7981 - DNA, 50 bp, Homo sapiens
gcaggagagcgagagaggagaagaagaggcaggagggagaaagagcgtac

SEQ ID NO: 7982 - DNA, 50 bp, Homo sapiens; identical to SEQ ID NO: 3889

SEQ ID NO: 7983 - DNA, 50 bp, Homo sapiens
agaggaaagaataggaccagtgccgaggtatagggaggagggcatactaa

SEQ ID NO: 7984 - DNA, 50 bp, Homo sapiens
tcggagtaagggcgattgtctcgttaggtaatacatcatcttcgtgcata

SEQ ID NO: 7985 - DNA, 50 bp, Homo sapiens
agacaagacgagcaacgacaaccacagcagctccatacactctgcctctc

SEQ ID NO: 7986 - DNA, 50 bp, Homo sapiens; identical to SEQ ID NO: 2595

SEQ ID NO: 7987 - DNA, 50 bp, Homo sapiens; identical to SEQ ID NO: 1567

SEQ ID NO: 7988 - DNA, 50 bp, Homo sapiens; identical to SEQ ID NO: 1572

SEQ ID NO: 7989 - DNA, 50 bp, Homo sapiens
cgtgccagatataactgtcttgtttcagtgagagacgccctatttctatg

SEQ ID NO: 7990 - DNA, 50 bp, Homo sapiens
tccctgaggcttgtgtatgttggatattgtggtgttttagatcactgagt

SEQ ID NO: 7991 - DNA, 50 bp, Homo sapiens
cagagaagaaacctactacagaggagaagaagcctgctgcataaactctt

SEQ ID NO: 7992 - DNA, 50 bp, Homo sapiens
tcagaacatagatatgtattcagcttgtcttcaaatacggccaagcagaa

SEQ ID NO: 7993 - DNA, 50 bp, Homo sapiens
ttggggtcaagtgaaagggtagggggatagtcctgatcaagtgtgataaa

SEQ ID NO: 7994 - DNA, 50 bp, Homo sapiens; identical to SEQ ID NO: 1626

SEQ ID NO: 7995 - DNA, 50 bp, Homo sapiens
ccttctcttcatgtgtgtaaatctgtaatataccattctctgtggcctgt

SEQ ID NO: 7996 - DNA, 50 bp, Homo sapiens
ggatggcacttccccaccggatggacagttattttgttgataagtaaccc

SEQ ID NO: 7997 - DNA, 50 bp, Homo sapiens
tgagtcagtgtctttactgagctggaagcctctgaaagttattaaaggca

SEQ ID NO: 7998 - DNA, 50 bp, Homo sapiens; identical to SEQ ID NO: 1636

SEQ ID NO: 7999 - DNA, 50 bp, Homo sapiens
gtggcttgctagtctgttacgttaacatgcttttctaaaattgcttcacg

SEQ ID NO: 8000 - DNA, 50 bp, Homo sapiens
ttgtactcactgggctgtgctctcccctgtttacccgatgtatggaaata

SEQ ID NO: 8001 - DNA, 50 bp, Homo sapiens; identical to SEQ ID NO: 2774

SEQ ID NO: 8002 - DNA, 50 bp, Homo sapiens
ttgttgttttccctgatttagcaagcaagtaattttctcccaagctgatt

SEQ ID NO: 8003 - DNA, 50 bp, Homo sapiens
ttagaaacaaaaagagctttccttctccaggaatactgaacatgggagct

SEQ ID NO: 8004 - DNA, 50 bp, Homo sapiens; identical to SEQ ID NO: 2180

SEQ ID NO: 8005 - DNA, 50 bp, Homo sapiens
gatgtctggtgcccaatcccaggaagtgagagccatttcttttgtactgg

SEQ ID NO: 8006 - DNA, 50 bp, Homo sapiens
agttggactaaatgctcttccttcagaggattatccggggcatctactca

SEQ ID NO: 8007 - DNA, 50 bp, Homo sapiens; identical to SEQ ID NO: 1736

SEQ ID NO: 8008 - DNA, 50 bp, Homo sapiens
aaacacatacacacaaaacagcaaacttcaggtaactattttggattgca

SEQ ID NO: 8009 - DNA, 50 bp, Homo sapiens
ctgaggatgagctggaaggagtgagaggggacaaaacccaccttgttgga

SEQ ID NO: 8010 - DNA, 50 bp, Homo sapiens; identical to SEQ ID NO: 7353

SEQ ID NO: 8011 - DNA, 50 bp, Homo sapiens; identical to SEQ ID NO: 1465

SEQ ID NO: 8012 - DNA, 50 bp, Homo sapiens; identical to SEQ ID NO: 1777

SEQ ID NO: 8013 - DNA, 50 bp, Homo sapiens; identical to SEQ ID NO: 4556

SEQ ID NO: 8014 - DNA, 50 bp, Homo sapiens
ggacagcccacagggaggtggtggacggactgtaattgatagattgatta

SEQ ID NO: 8015 - DNA, 50 bp, Homo sapiens
attgaagccgactctggccctggcccttacttgcttctctagctctctag

SEQ ID NO: 8016 - DNA, 50 bp, Homo sapiens
actagactttatgccatggtgctttcagtttaatgctgtgtctctgtcag

SEQ ID NO: 8017 - DNA, 50 bp, Homo sapiens
gagccatatgaaagagaccatgccgtggtcgtgggagtgtacaggccacc

SEQ ID NO: 8018 - DNA, 50 bp, Homo sapiens
ataacagactccagctcctggtccacccggcatgtcagtcagcactctgg

SEQ ID NO: 8019 - DNA, 50 bp, Homo sapiens
ctggcctctgtgtcctagaagggaccctcctgtggtctttgtcttgattt

SEQ ID NO: 8020 - DNA, 50 bp, Homo sapiens
cccaaagctcactttacaaaatatttcctcagtactttgcagaaaacacc

SEQ ID NO: 8021 - DNA, 50 bp, Homo sapiens
atgtctgctagaaagtgttgtagttgattgaccaaaccagttcataaggg

SEQ ID NO: 8022 - DNA, 50 bp, Homo sapiens
ctctgcatgttctgctcttgtgcccttctgagcccacaataaaggctgag

SEQ ID NO: 8023 - DNA, 50 bp, Homo sapiens
tgcatcgtaaaacctttcagaaggaaaggagaatgttttgtggacacgtt

SEQ ID NO: 8024 - DNA, 50 bp, Homo sapiens
agccctattcatgtctctacccactatgcacagattaaacttcacctaca

SEQ ID NO: 8025 - DNA, 50 bp, Homo sapiens
agtgacagtgaacttaagcaaattaccctcctacccaattctatggaata

SEQ ID NO: 8026 - DNA, 50 bp, Homo sapiens
acacatgccctgaatgaattgctaaatttcaaaggaaatggaccctgctt

SEQ ID NO: 8027 - DNA, 50 bp, Homo sapiens
gccactgaaccaatcactttgtatgctatgctcctactgtgatggaaaac

SEQ ID NO: 8028 - DNA, 50 bp, Homo sapiens; identical to SEQ ID NO: 3262

SEQ ID NO: 8029 - DNA, 50 bp, Homo sapiens; identical to SEQ ID NO: 4798

SEQ ID NO: 8030 - DNA, 50 bp, Homo sapiens
gctccatgttctgacttagggcaatttgattctgcacttggggtctgtct

SEQ ID NO: 8031 - DNA, 50 bp, Homo sapiens
gcagcagcttaatttttctgtattgcagtgtttataggcttcttgtgtgt

SEQ ID NO: 8032 - DNA, 50 bp, Homo sapiens; identical to SEQ ID NO: 106

SEQ ID NO: 8033 - DNA, 50 bp, Homo sapiens; identical to SEQ ID NO: 8024

SEQ ID NO: 8034 - DNA, 50 bp, Homo sapiens
acatggaagactaaactcatgcttattgctaaatgtggtctttgccaact

SEQ ID NO: 8035 - DNA, 50 bp, Homo sapiens
agacccctgtgatgcctgtgacctcaattaaagcaattcctttgacctgt

SEQ ID NO: 8036 - DNA, 50 bp, Homo sapiens; identical to SEQ ID NO: 2893

SEQ ID NO: 8037 - DNA, 50 bp, Homo sapiens
ctgtagactcagtgccagccacagcttcagagattgtgctcacatggtat

SEQ ID NO: 8038 - DNA, 50 bp, Homo sapiens
tgacaaaggattttacgtttataaaattatgacagaagccatgtgccccg

SEQ ID NO: 8039 - DNA, 50 bp, Homo sapiens
gtctgccctgctggctggaaacctggtagtgaaacaataatcccagatcc

SEQ ID NO: 8040 - DNA, 50 bp, Homo sapiens
ctcgtcatacaatgcctgatgggctcctgtcaccctccacgtctccacag

SEQ ID NO: 8041 - DNA, 50 bp, Homo sapiens
ctagggagccgcaccttatcatgtaccatcaataaagtaccctgtgctca

SEQ ID NO: 8042 - DNA, 50 bp, Homo sapiens
tccgtatccattacttcgacccacagtactttgaatttgagtttgaggct

SEQ ID NO: 8043 - DNA, 50 bp, Homo sapiens
ccagtcctccacacccaaactgtttctgattggcttttagctttttgttg

SEQ ID NO: 8044 - DNA, 50 bp, Homo sapiens
ctgttgtctctctgaggctgccagttgttgtgtgttaccgatgccagaag

SEQ ID NO: 8045 - DNA, 50 bp, Homo sapiens
aatatagtcaagcaagtttgttccaggtgacccattgagctgtgtatgca

SEQ ID NO: 8046 - DNA, 50 bp, Homo sapiens
tttgctattttcgtcatgcctttgagactgagtcttactccgtcccccag

SEQ ID NO: 8047 - DNA, 50 bp, Homo sapiens; identical to SEQ ID NO: 2117

SEQ ID NO: 8048 - DNA, 50 bp, Homo sapiens
caggaaggaggtaggcacctttctgagcttattctattccccacccacac

SEQ ID NO: 8049 - DNA, 50 bp, Homo sapiens
gggagccatccctctctaccaaggtggcaatgatggagggaacttgcatg

SEQ ID NO: 8050 - DNA, 50 bp, Homo sapiens
tggcccgcaatactgtaggaacaagcatgatcttgttactgtgatatttt

SEQ ID NO: 8051 - DNA, 50 bp, Homo sapiens; identical to SEQ ID NO: 2151

SEQ ID NO: 8052 - DNA, 50 bp, Homo sapiens; identical to SEQ ID NO: 4517

SEQ ID NO: 8053 - DNA, 50 bp, Homo sapiens
tggggactatagtgcaacctatttgggtaaagaaaccatttgctaaaatg

SEQ ID NO: 8054 - DNA, 50 bp, Homo sapiens; identical to SEQ ID NO: 2269

SEQ ID NO: 8055 - DNA, 50 bp, Homo sapiens; identical to SEQ ID NO: 2480

SEQ ID NO: 8056 - DNA, 50 bp, Homo sapiens
gaggaggttgcccagaagaaaaagatatcccagaagaaactgaagaaaca

SEQ ID NO: 8057 - DNA, 50 bp, Homo sapiens
aacctaccagcccttctcccccaataactgtgggtctatacagagtcaat

SEQ ID NO: 8058 - DNA, 50 bp, Homo sapiens
agagagttggaccactattgtgtgttgctaatcattgactgtagtcccaa

SEQ ID NO: 8059 - DNA, 50 bp, Homo sapiens
ccctgtactgctgctgcgacctgatgctgccagtctgttaaaataaagat

SEQ ID NO: 8060 - DNA, 50 bp, Homo sapiens; identical to SEQ ID NO: 2106

SEQ ID NO: 8061 - DNA, 50 bp, Homo sapiens; identical to SEQ ID NO: 106

SEQ ID NO: 8062 - DNA, 50 bp, Homo sapiens; identical to SEQ ID NO: 2926

SEQ ID NO: 8063 - DNA, 50 bp, Homo sapiens
tctctgctcaatctctgcttggctccaaggacctgggatctcctggtacg

SEQ ID NO: 8064 - DNA, 50 bp, Homo sapiens
tgtcttactcaagttcaaacctccagcctgtgaatcaactgtgtctcttt

SEQ ID NO: 8065 - DNA, 50 bp, Homo sapiens; identical to SEQ ID NO: 4159

SEQ ID NO: 8066 - DNA, 50 bp, Homo sapiens
tggtgagtggaatttgacattgtccaaacctttttcatttttgagtgatt

SEQ ID NO: 8067 - DNA, 50 bp, Homo sapiens
gagtgaggaagacccccaagcatagactcgggtactgtgatgatggctgc

SEQ ID NO: 8068 - DNA, 50 bp, Homo sapiens
tggcaaagcccctcacactgcaagggattgtagataacactgacttgttt

SEQ ID NO: 8069 - DNA, 50 bp, Homo sapiens
ggaaaggaaactttgaaccttatgtaccgagcaaatgccaggtctagcaa

SEQ ID NO: 8070 - DNA, 50 bp, Homo sapiens
agttaagattattcagaaggtcggggattggagctaagctgccacctggt

SEQ ID NO: 8071 - DNA, 50 bp, Homo sapiens
ttaccttgtggatgctagtgctgtagagttcactgttgtacacagtctgt

SEQ ID NO: 8072 - DNA, 50 bp, Homo sapiens
ggggtcttcacattatcataacctctcctctaaaggggaggcattaaaat

SEQ ID NO: 8073 - DNA, 50 bp, Homo sapiens
tttccttgtgcaattcagacttaagcatcgagtttttaccatcttccact

SEQ ID NO: 8074 - DNA, 50 bp, Homo sapiens; identical to SEQ ID NO: 3840

SEQ ID NO: 8075 - DNA, 50 bp, Homo sapiens
aaatgtagcttttggggagggaggggaaatgtaatactggaataatttgt

SEQ ID NO: 8076 - DNA, 50 bp, Homo sapiens
acccactgcaaaagtagtagtcaagtgtctaggtctttgatattgctctt

SEQ ID NO: 8077 - DNA, 50 bp, Homo sapiens
gcctgctgtgaactgctttccctcggaatgtttccgtaacaggacattaa

SEQ ID NO: 8078 - DNA, 50 bp, Homo sapiens; identical to SEQ ID NO: 2582

SEQ ID NO: 8079 - DNA, 50 bp, Homo sapiens; identical to SEQ ID NO: 2817

SEQ ID NO: 8080 - DNA, 50 bp, Homo sapiens; identical to SEQ ID NO: 3865

SEQ ID NO: 8081 - DNA, 50 bp, Homo sapiens
ttgggggaaatgttgtgggggtggggttgagttgggggtattttctaatt

SEQ ID NO: 8082 - DNA, 50 bp, Homo sapiens
agcatggtaaacctgggttttgttcatattttctccagacagaaatgcaa

SEQ ID NO: 8083 - DNA, 50 bp, Homo sapiens; identical to SEQ ID NO: 887

SEQ ID NO: 8084 - DNA, 50 bp, Homo sapiens
gcccttgatgctggagtcacatctgttgatagctggagaactttagtttc

SEQ ID NO: 8085 - DNA, 50 bp, Homo sapiens
gccgattccaagcgagggatttaatccttacatttttgcccatttggctc

SEQ ID NO: 8086 - DNA, 50 bp, Homo sapiens
ttccctggacagtttgatgtgcttatggttgagatttataatctgcttgt

SEQ ID NO: 8087 - DNA, 50 bp, Homo sapiens
ggcggtgactgccccagacttggttttgtaatgatttgtacaggaataaa

SEQ ID NO: 8088 - DNA, 50 bp, Homo sapiens
tgaccatttggaggggcggggcctcctagaagaaccttcttagacaatgg

SEQ ID NO: 8089 - DNA, 50 bp, Homo sapiens
cagtcctcacaccagccaaggtcacaggcaagagcaagaagagaaactga

SEQ ID NO: 8090 - DNA, 50 bp, Homo sapiens
cctcagtgatggaatatcatgaatgtgagtcattatgtagctgtcgtaca

SEQ ID NO: 8091 - DNA, 50 bp, Homo sapiens
acacacaacttcagctttgcatcacgagtcttgtattccaagaaaatcaa

SEQ ID NO: 8092 - DNA, 50 bp, Homo sapiens
ggaatttcgcaccagaggacccaccacgtcctcgcttcgacatcttgaac

SEQ ID NO: 8093 - DNA, 50 bp, Homo sapiens; identical to SEQ ID NO: 2067

SEQ ID NO: 8094 - DNA, 50 bp, Homo sapiens
cagagaaagaaaaggcaaaagactggtttgtttgcttaatttccttctgt

SEQ ID NO: 8095 - DNA, 50 bp, Homo sapiens
gaaagcagggaagcagtgtgaactctttattcactcccagcctgtcctgt

SEQ ID NO: 8096 - DNA, 50 bp, Homo sapiens; identical to SEQ ID NO: 7214

SEQ ID NO: 8097 - DNA, 50 bp, Homo sapiens; identical to SEQ ID NO: 75

SEQ ID NO: 8098 - DNA, 50 bp, Homo sapiens; identical to SEQ ID NO: 7278

SEQ ID NO: 8099 - DNA, 50 bp, Homo sapiens
tgcaactagcaactcatcttcggaagacacagccaggagaatgaagtaga

SEQ ID NO: 8100 - DNA, 50 bp, Homo sapiens
gactttcctctctgcgagcttctacttctaagtctgaatccagtcagaaa

SEQ ID NO: 8101 - DNA, 50 bp, Homo sapiens
gtttctctttggttttccagattttctttagaacggtgactgaccctcct

SEQ ID NO: 8102 - DNA, 50 bp, Homo sapiens
ctgagcaataactagcataaccccttggggcctctaaacgggtcttgagg

SEQ ID NO: 8103 - DNA, 50 bp, Homo sapiens
tgcccatttcacattgctcattactcatgcaaatttcttcttgctaacct

SEQ ID NO: 8104 - DNA, 50 bp, Homo sapiens
acccaccattggtaaaatattcaggggaacttggtttaaaagtttatgct

SEQ ID NO: 8105 - DNA, 50 bp, Homo sapiens
gtcaaataaggttgttctttccttgaaggacagcacccatgccacagcac

SEQ ID NO: 8106 - DNA, 50 bp, Homo sapiens
ctggaaaaacatcacatggttgagtcaaggatgaaaagtcaaaactacct

SEQ ID NO: 8107 - DNA, 50 bp, Homo sapiens
atccatccaataaacacagcaacaccctatgctactgaccaagcaaagct

SEQ ID NO: 8108 - DNA, 50 bp, Homo sapiens
tagttagagtccaagacatggttcctccccctttgtctgtacatcctggc

SEQ ID NO: 8109 - DNA, 50 bp, Homo sapiens
cagcctgcctgcttgccatttttcttccccttccatttttctaacctcag

SEQ ID NO: 8110 - DNA, 50 bp, Homo sapiens
acttcctccccctccccctagcattacttatatgatatgtttccataccc

SEQ ID NO: 8111 - DNA, 50 bp, Homo sapiens; identical to SEQ ID NO: 6215

SEQ ID NO: 8112 - DNA, 50 bp, Homo sapiens
tttgcatcccgagttttgtattccaagaaaatcaaagggggccaatttgt

SEQ ID NO: 8113 - DNA, 51 bp, Homo sapiens; identical to SEQ ID NO: 5699

SEQ ID NO: 8114 - DNA, 50 bp, Homo sapiens
aaaaacggtttatgggggtagggaaacaggccgaaaagaacgtggagaaa

SEQ ID NO: 8115 - DNA, 50 bp, Homo sapiens
ggggactcaggcccccgctgggggtcccacatagggtttttatccaaaaa

SEQ ID NO: 8116 - DNA, 50 bp, Homo sapiens; identical to SEQ ID NO: 4235

SEQ ID NO: 8117 - DNA, 50 bp, Homo sapiens; identical to SEQ ID NO: 6061

SEQ ID NO: 8118 - DNA, 50 bp, Homo sapiens; identical to SEQ ID NO: 6136

SEQ ID NO: 8119 - DNA, 50 bp, Homo sapiens
agccatagaaggtgttcaggtattgcactgccaactctttgtccgttttg

SEQ ID NO: 8120 - DNA, 50 bp, Homo sapiens
ccatgcccttgtcatcaatcttgaatcccatagctgcttgaatctgctgc

SEQ ID NO: 8121 - DNA, 50 bp, Homo sapiens
ttaagaatgtggcagaaatgtatgctgaggtagcccagtcaatccttatt

SEQ ID NO: 8122 - DNA, 50 bp, Homo sapiens
atcagtagcaaaacaaacccagcaacttctgtccagcatctgctgtaggg

SEQ ID NO: 8123 - DNA, 50 bp, Homo sapiens
cccatctaactagcacacgaaccttccacgaggacgcctggcgagagaag

SEQ ID NO: 8124 - DNA, 50 bp, Homo sapiens
gaacttggcagttgtagcagaggcagttgaggcttgttgaccatcaccat

SEQ ID NO: 8125 - DNA, 50 bp, Homo sapiens
cgctctctcctgcacagcaccaccaccaacagtctggatgattttaggca

SEQ ID NO: 8126 - DNA, 50 bp, Homo sapiens
ttttgggaagaaaaccctatgcatctgaaatacaattggcaatggaagct

SEQ ID NO: 8127 - DNA, 50 bp, Homo sapiens
ctctttgttgctactcatttctctccggcgtctgctgaggggtaggtgtc

SEQ ID NO: 8128 - DNA, 50 bp, Homo sapiens
caacttcctcttggttacccagaagaacagcagcaccgtgatccagagca

SEQ ID NO: 8129 - DNA, 50 bp, Homo sapiens
ctgtacatctgcatcccagcaaagagcagcagggacaggagggaggagag

SEQ ID NO: 8130 - DNA, 50 bp, Homo sapiens
cacagacagaaggtttcgttcctcattcgacagtggctcattcagctctg

SEQ ID NO: 8131 - DNA, 50 bp, Homo sapiens
tcaagattggcaattcactgtgcccattaaaccactcagtagctcagcct

SEQ ID NO: 8132 - DNA, 50 bp, Homo sapiens
agttgtcctgagagttttacacttgtgagaaaatactggcagctttgatt

SEQ ID NO: 8133 - DNA, 50 bp, Homo sapiens
cacataggaatccttctgacccatgcccaccatcacgccctggtgcctgg

SEQ ID NO: 8134 - DNA, 50 bp, Homo sapiens
aacaggaacctttatctctttgtgaggcgatttgcattctccacacaggc

SEQ ID NO: 8135 - DNA, 50 bp, Homo sapiens
gtacttgccgccggtggcctcattgtagtacacgttgatgcgttccagct

SEQ ID NO: 8136 - DNA, 50 bp, Homo sapiens
atagtggctagggattaggaggcgaaggcgacaggagcagacaccgggtc

SEQ ID NO: 8137 - DNA, 50 bp, Homo sapiens
cattttggcttttaggggtagttttcacgacacctgtgttctggcggcaa

SEQ ID NO: 8138 - DNA, 50 bp, Homo sapiens
ccctggttcaggaattaaggggacagacttgaataagaaacaaaacaaaa

SEQ ID NO: 8139 - DNA, 50 bp, Homo sapiens
acagtagagaatttgagtacacagggtatggagagtagggcacaaaatgt

SEQ ID NO: 8140 - DNA, 50 bp, Homo sapiens
gaacagcctcgtctttccccgaatgccaggcaggatgacgatgaacgtgg

SEQ ID NO: 8141 - DNA, 50 bp, Homo sapiens
gacctccagaatttcctcatcgctgtcggtgaccaagtccacagacacta

SEQ ID NO: 8142 - DNA, 50 bp, Homo sapiens
tcttgccatcctatggaactgcctcggtgagttttctccttcattacaga

SEQ ID NO: 8143 - DNA, 50 bp, Homo sapiens
tgttactccttcaagcccctgaatcactatagccacgactctccaactga

SEQ ID NO: 8144 - DNA, 290 bp, Homo sapiens
  misc_feature (1)...(290): n = A,T,C or G
agtcaacctaccaaagaccatacctgacacctaggctctctcacccaatggaatagactctaatggtgatacataccaataangggaaatctagtggtggtaaactgtttatgcctcattctatgaaagctgaaagattgctgttagctgtatgatgtataatgctaatcgcgatangggtacattgtcttctacagactcctacatatgtatgattatcacagtatgatgccagatactaacattcatattgaacaaatggctggcgtgggtagatgtcaagagaacat

SEQ ID NO: 8145 - DNA, 386 bp, Homo sapiens
ggcaggtggagaacacaaacgagtgagagctgactgtagtcgaagatcatacaaggaaaggtaagaaggcctgcaagctgtgaattagacataatacattattaattataggatgtaacattatgtatatggggaatatatatctaaacttatttatcaatatttaatattatatatatggggtatgtgtatgtaaacgcatatatattatatatatgtattattaataacttttgtgttatgagactgaatatctataaatatatgttttattaataattactatatgctgtgtaagtatcacgttatattttgtgtgctgactaagtaagcaacgctatgtagatacaaagagttgtgtgatggagtccactggtgatacaacg

SEQ ID NO: 8146 - DNA, 354 bp, Homo sapiens
cgagtacaagctttttttttttattttatttcttgttctggctatgatgacaaactgggtagtatatgatatatataacgtagagaagagtaacatatagacacaaaaaatatatatgagtcatgtattaactagaaatgcacataagataaaatggcctattgaatcatgtttttattatagatatattacaaaatggcattgaaggaaacctacttatttttcaatatgagaacaacagaaggcttttatgtatcacgaaaataacaatatatctgattttataatttataatttacattacataagctgagaactacacaataaaaactcaccaatattgaatattatata

SEQ ID NO: 8147 - DNA, 226 bp, Homo sapiens
atctcgaaggcaactcgcatgcacactagcaacatatataaacaatcttatattagactgtaaatggaaactgtaaagtgattagcttgaatcttttgtgcgaaagatttgtaacagacaatcgggtgaaatcacctcgcgcatgttatggagagattgtgacgttcaggacaaaacgagtaacagactgatcttctgtttgatactacgaccaggactccaggac

SEQ ID NO: 8148 - DNA, 530 bp, Homo sapiens
  misc_feature (1)...(530): n = A,T,C or G
gacactgagtctaggaatangcacatatggagctaaagacctatgctttaaatactctaaatatatagactacacaaaaacatatgggaaaaatgtactgatgctaagataatattgttgatatcatattgtagaaactataactttaaaccaatagttgtgagcataaatgttacagtgatattgtgtgtaatatatagtacatgtaaaaatgaaactaaatttatatataattgtatatatgacatcaacaatgtaattgatattcttgctgttatcacaacactcgaaattaatgaatgctacagacatggattaaaaagactangctctctaaagagataaagaatattacttaaagcacatattattatgtgtaatacactattagaagattagatctaaactatacaacacanaacgtacttcttttcatcatcctctgctacaaactattgccctcctcaaaatatagacgattgctaaaagagtctgagcgatgatgccatcaatgaacaaacgttttgagt

SEQ ID NO: 8149 - DNA, 514 bp, Homo sapiens
  misc_feature (1)...(514): n = A,T,C or G
tgtcttggagtaaattttaagttcatggatgtaatgtggtctacaggaatactgtatttgtaaaaaaataagaacattctgcaactgtagaaatgaccccattatatattttctgaaaatgaaaacagttacatgaaaaaaatgaccaatgaacatgtcatcatttgatgaaaaaccagaagttattagatgagagcagcgagtgaatctttaaaacagacttgatcacgcacactcaataagtaatatctctccgaaaccggatgtcattctatatctgttagaaataatgtcatcaaaagaaagtaaattagaggatatttttgccaatagtttatacaaaatatatgaaccaaagagattggaatttgtaaaaatgtaaaatagtatgaacaatatttgcactctaccatatttgaacatctnnatgagttcacattcatactaggttatcaacattgcgttctttttgcattcattctttactgttattaaaagttcaaaaccaatataa

SEQ ID NO: 8150 - DNA, 170 bp, Homo sapiens
  misc_feature (1)...(170): n = A,T,C or G
ccactattatgggatttgttttagtccattatggattctggatattcaancatttacaatgtagcatatttgattttcttttttctttctttttttggcatcattaacatttcatttgaaatgcatattgttcttgaagtacctcggccgcgaccacgctaatcactagt

SEQ ID NO: 8151 - DNA, 162 bp, Homo sapiens
aggcgacagggaatggcaagtttctgaagtcggcatagcttagttgttgcatccagcagagagacagcacagggagcagcctacgcaggaagattacaacagaggaataacacagaatacaatctgggatggataatagtgaatggcatccactagatgatt

SEQ ID NO: 8152 - DNA, 498 bp, Homo sapiens
cagtctttttttttttttttttttttttttttttgggtttggaacctttaataaaaataaaaaaggaatgcaaaaagaacacaatgttgaaaacttaatatgaatgtgaacctcactagatgttcaaatctgggagagtgcaaattttggtcatactattttacatttttacaaactcaaatcactttggttcatatattttctataaactattggcaaaaaaatcctcaaatttacattcttttggctacattatttctaacagatatagatttacttccgggttcggagagaaagacttattgtgtgtgcgtgaacaagtctggtttaaagattcactcgctgctttcatctaataacttctggtttttcataaaatggtgacatcttcattggaaatttttttcatgttactggtttcattttcagaaaaattataagggggggattccaaaggtcagaaagatcctatttttttaaaaaaaaaaaattctggta

SEQ ID NO: 8153 - DNA, 194 bp, Homo sapiens
actattaagttctttcacaaaataatcatcttatatcaacacagtaccaatctaagtgtccgcaggagggttactttaacatctccctcctgtgtttactccaatgtttctccctttaggtatggtctgggtaaatcggtttatggatgcatctgtccacaccacgctcgcagcatgtcactctgcgcattaag

SEQ ID NO: 8154 - DNA, 178 bp, Homo sapiens
gtgcgctggctatggacacgtaaaggaattgccacatggtggacattgattgcaaattgttgaggggatggaaaggatgttggacgttctggtgaaaagctggaagatggccctaaattcttgaagtactggtgaagctgtcattgtcgatttgggtggtggatagcttctgtacgtg

SEQ ID NO: 8155 - DNA, 450 bp, Homo sapiens
caactattatactattctcttctgctttcattctgatgtggtctgtaatagcaaaatacatgacttatttgtgtggatggcaaaacaaaaggtgtgtgttggatggtctgcttatcagtggatgatacaacagtcaagcaaaacctcgcggccctaacccaaaatcgatgaatctttggaacttgaaagacaatctggcctgtatgaatgggcaaacagcgaccatcattcgaaatgaaactggtaggcagtcacatttgacattcatgatcttcactggctactcgtccagactcaaaacgctggtgactgttaacagtgtcaggttttaaccaagcggaattccattaaatatttgccccaatgctctggaaactgggagagaatctttgcactgtgatagctgctacactgtgcgcctgaacacagcgccattggtggtaccccccg

SEQ ID NO: 8156 - DNA, 178 bp, Homo sapiens
tatcatatacataaaacagatggctggggaggaaggaagacaaacaagaatgactcagctggatggacatacacttaatgcatgatcaatcatcaatctgtctgttatacattagttggtgagtgggatgtccatacattaactattgaatgaaaggtaagttatttaatatatttat

SEQ ID NO: 8157 - DNA, 226 bp, Homo sapiens
ttttttttttttttttttggttttgaacctttaataaaagtaaaaaatgaatgcaaaaagaacacaatgttgaaaacttaatatgaatgtgaacctcactagatgttcaaatctgggagagtgcaaattttgttcatactattttacattttttacaaactcaaatcactttggttcatatattttctattaactattggcaaaaaaatcctcaaactctcattcc

SEQ ID NO: 8158 - DNA, 530 bp, Homo sapiens
tactgactatggaaacatgaatatatgtaagggccattcatgatatatgaatgagaagagtaagctttcatatggaaaaacacaatcattcaaaaaatgaatgacatgctgatgtatagcaacacgcatcataaaatgaagagtatatcaataacatatctatgcttagataagtactaccttctgtgtattatagaacaataagtgtgcattggttgtactttgcaactaacgcatgggtatcatgggtatgcacccatcatgatggagtctggattaccatcttgcttttggataaaacagatctatttggggcatctacataggattaatagagagagaaagaggatatatgattcataaatcatatatgctctgatcaaatgcaagcatcattaaaaaacatatgctatctataactactcatcagattgctgtgatctatacactctctccacatattaatactgtgaaacttcaactatagcacattactctggatatgcaaagttagcacggtaggacatgaa

SEQ ID NO: 8159 - DNA, 578 bp, Homo sapiens
agcatttaatccaaacaggggttcttagcctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaaatagaaaaagcacttgaagaatattcccaatattcccggtcagcagtatcaaggctgacttgtgttcatgtggagtcattataaattctataaatcaattattccccttcggtcttaaaaatatatttactcataaacatttgtgttttgttgaaaagatggagtttacaaagataccattcttgagtcatggatttctctggtcacagaatggtgtggcatttggaaacgggaataaacaaaattgctgcatcaatgcactgagtgaaggaagagagacagaggatgaagggttttaga

SEQ ID NO: 8160 - DNA, 530 bp, Homo sapiens
ggtgaggtagtatgtgagtgaaataaatggatggaattagtgatatgaataattgaagtttgagaagtagaatggatgggcgtgttgtgattattagtaaaataagatagaagaatgttgtaagaattatatggatggatatgatatgtaggttattattgtaatttatacttttatgaattgtgaataaggaaatatattctatatagattaggagtgaaagaatcaggtttataaagtgaaataattaaatagaatgcagaaatgaagagaaagggatattgtgtaacatattattggaagaataattaaaatatttaatatgtgttataaaagtgaagataaaagtgtatttttatgaacagaattgttatgaaatattatttttacattaaattaaaagtgtattgagtgaatatgttaaggaatatttattggaaatattagagttaggtacaattgaagaaatgtgtgaatgaagaagaggaagtgattactgggtgaaattatagtgaattggaaataattga

SEQ ID NO: 8161 - DNA, 693 bp, Homo sapiens
gcggtggttgtgatcggctatgtgggtagcttggtggtgtggtggcggcagtgaggggctaggatgggtggtaggatatctaggactgagacggagacttgacctccacgatgcaacatccaatgagtatgctatgtgagaaaaatgagagattaacgagctaaatgcagtgtgtatgatgtgtgagaacatcacagatggatgatcgcacaagaggcatttgcatgatatgatcgcttcatagatggaataatcgaactggtgaatatgtatgagctgtgatgaatgttgctgcagaatccatctgttgaaccatgtatatgcaatgtgtgaggaggctagatgaatggatcatatcatgatgatgttaacaatgttgggtgagattgctatggtgacaaatcatgtggatgtatacaggaatatttctggttgctgcggttgacaaccatgggggatcagacaagagaagtagtagagagtgatgttgacatcgatgggggatacgcttataaatgatgaagtggatgacgtgtgcatgtggagcgtatacgatagttactaacgagtttggagcatagtgtgagtattatatattgtcaagttaataacgtggtggatgcattgttatagttgtttattgtgtgaaattgatatctggttataattatggtcataatttgtatcctgtaa

SEQ ID NO: 8162 - DNA, 194 bp, Homo sapiens
atgatagttgtgaaatgattgattggagggtaagttattggttgtttttagatttaggttagaaagaggaggtatgtggataggagtaaataatgtgattggtttattgggtgaaatattatgttttgttgtttggatatatggaggatggtgattttagtttggataatagaggttatataaatgcaatggaa

SEQ ID NO: 8163 - DNA, 466 bp, Homo sapiens
cagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgaagtttgttgaaaagatggaggttacaaagataccattcttgaagc

SEQ ID NO: 8164 - DNA, 672 bp, Homo sapiens
cccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaagataagctgaaagactgccttgaaaatcagcaaaagcttttagtgctgtcca

SEQ ID NO: 8165 - DNA, 514 bp, Homo sapiens
  misc_feature (1)...(514): n = A,T,C or G
ggcttgggctgctggggcaggggcaactggaggcaagcggaaaacgacgattagttctttatgtatgataataaattaatattaatacatatanatatatagatattatgtaaatgttactatgataatggttatcgtttatacgttatcgtaatatcataagatttttatacaaaatcaaaatacgaagactactaacatgaggatggagaaggaaaaaagtttctgaatcttgaccgtggctgaggcggagacgattcttggacttggagctgtatctgtatgtaaatgaacatagaggaatacgactacagaacctaataccaataccaggacaatggctctgcatttaaatgatagtgactgtgactgaatacagtttaagttaattgttgtaggtgattgtgattatattaatgcgatagcgtatattgagatgaagatctaagtgattgtgaacacttgaccttgatgtccctggacacagtgcattagcgtcatttctaggtcacgc

SEQ ID NO: 8166 - DNA, 402 bp, Homo sapiens
  misc_feature (1)...(402): n = A,T,C or G
ggtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgngagctttgttggtggtattgtattaacgctgggagttttatctattctttacattggatgcaaaaagtattactcagaagaagcattcgtatcgaaccataaatga

SEQ ID NO: 8167 - DNA, 322 bp, Homo sapiens
  misc_feature (1)...(322): n = A,T,C or G
ttctcccttaaggactttggcaagaataacaagttcattggaatttgactttctgacatagagcagacagccttgccctgtcatgccaggcctttcatgtgaagttaccatttattagctgcttctgtctctccnagggaagatttcccttttataagcctgggccagggggatgatagtaagattccccatgtgataccagagttggaataagctgtagtgagattanggccaggactgtcccattttgattcttgaatggtttctgttacaacttgtcatgggggaaaaagtaacacttattttttttttcctcccttaa

SEQ ID NO: 8168 - DNA, 290 bp, Homo sapiens
tactatgatatgtgaatggaaaagtaggcagctgatgactcaaattaagaattttaattacattgactccaagtctgatattctgatgagtgtcatatagcacttaatgtctgcttcatataatactaccacttattagatatatatagactcaagagcattaacaaaagtagagaaagagtgagtcattatatacctatgagtaaaatatgaaaatgactatatgtgtctgtctgtgtcttgttatcggtgatgcaaatagttaattcttgatggaagctgtcgacgtg

SEQ ID NO: 8169 - DNA, 242 bp, Homo sapiens
  misc_feature (1)...(242): n = A,T,C or G
cggtggtncatcgcttgntggtgtggttcttatnattaacnccattgtgtatacaggtttccagtcccttggggtacagtagtggttggccagatggttatgtaagtatttggagtcaggtgtataatggattttcgggtgatatggatgtaaagaaaagctttccttgttcacccggacttgaaatcgtggagttttaatagcagatcttcagcaggtgagagaatcacagctgcattcca

SEQ ID NO: 8170 - DNA, 178 bp, Homo sapiens
ctgtcgagaatggaggattcttacgtggacatgagttgcattgttctttgatgctgtaggcttattaaaagtatgtagtgactagtttccaggcacttggaatctgtgttcctatggttggcggcatagcagctagcatttttgatcaccatacagcagggcttcgggtagtcgcgat

SEQ ID NO: 8171 - DNA, 242 bp, Homo sapiens
  misc_feature (1)...(242): n = A,T,C or G
ccagnaggttatccctgtacctgccctggtgattggccagcgaatcaggtctaaccagcacaactcccacctggaccagccgaaccagctctgagcatgagttgggtcagatctgaaacatcccctgcataaccccagcaagctacctcccctgctaattatggatgctcatctcctgcaagcatcaaccgcattggcagaagcagcaaacccacttcctccttgcttagcatggaccatgg

SEQ ID NO: 8172 - DNA, 722 bp, Homo sapiens
  misc_feature (1)...(722): n = A,T,C or G
gggaccgggaggtgacttagtgctgatactggcaattggnaaagatgagggacgnctgcttgcactccagcatgcggccatttttaattacattgtttcccaagtatgcatattctgnacatgtctatagcacttagtgtctgcttcatataaactaccagttattatatatttatgatgcaagtagttttccaaatgtggtgaaagtctgagtctttttatccccatgggtaaaatctgaatctggctctctgtgtctctctgtgcttgtttattgctggtcagagagtcaattcttgataaaagctgttgacttggctctcacagtttatgcagacattggagagacgatctggttatttcaaacatcacaggatctgagtaagaagacctggttatgaaacaaggctctcataattactagctatgactgttgacaagttaccttttcttgtttacaagttatttggcctctttgaattacttgtaaaatagagatagggattctttcttgatcatggaacatcaaatgaagttatttgatgaaatactttgttatctggaaattataaatatcacttcatgtttattattatttggaatttgggcttctcatggtggcattttctatggtcatttttttcttttcttgcataatggctataaagttagttagacatgcaaacaaatgccctaagtgggaaattttgaataggttaggg

SEQ ID NO: 8173 - DNA, 242 bp, Homo sapiens
ttgtttgcagagtcctcaaatgtatcacagaaaacagttgctgtggaaacttatagtggaccctactgacgcacaagcattaagaagtccacttgctgcatactgtaaggagaacttgctgcatttgggaaatgctgcttaaggcaacacacattacctttgtgacagggctctgtccactggggtgggctgatgcaatctatacagaatgcacatgctgcctttttttcttctttttttgc

SEQ ID NO: 8174 - DNA, 194 bp, Homo sapiens
  misc_feature (1)...(194): n = A,T,C or G
agcacgtaacccatccgatcccccaagattaaggaaaaagagtgggagagcaaatggaagaagcccctgctaacgggatgctaatgagaaatggggagcaggaggctgacaatgaggtagacgaagaagaggaagaaggtggggaggaagaggaggaggaagaagaaggngaaggtgaggggggggggggcggg

SEQ ID NO: 8175 - DNA, 354 bp, Homo sapiens
tttttttttttttttttttttttttgggcttcccaattattttaatgaagggattgggaggaggacatacaaaacggccagatacacagggtagcaggggcttgataatgagataattttcccccacgtgttgggaaaaaaaatactatgtatttttttatgaacactattaaaaaaaaataaacccactcacaacattttggagggactaaaggccaagagaaaccaatggagaatcattatttgggggatgggggggggagtttctggggggcagggggggatgtggacaggcaggggggggtggaggaaccttgcctctggcgggaatgggaaggagggacaaggaacaaa

SEQ ID NO: 8176 - DNA, 603 bp, Homo sapiens
ccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatattttgctttaaaatatattttggttattttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaacaaacgtagttgttttttactgatactaaatgttggctacctgtgattttatagtatgcacatgtcagaaaaaggcaagacaaatggcctcttggtccccgccg

SEQ ID NO: 8177 - DNA, 354 bp, Homo sapiens
ttattttatttatttggtattatgtttttttattttttttttttttgttatttttttttttttttgttttttttttttttttttttttttgttttttttttttttttttttgtttttgggggggggaataggagagggggggggaggggggggtgatgaagggggggggaaaagaggatttataatataaaaaaagggggaattaaagggggggagagaagttaatgaaaaggaggaaaaaaaaggatatattaataaaaaaaaattggaaaaaagggggagttttttattaagaggggggtatattttggggggaaaaaaatatggggggggggaaaaaaataatagtttggg

SEQ ID NO: 8178 - DNA, 352 bp, Homo sapiens
acggattgaattgactgatgcatgctcacatatgtctaaaaacaatctgtctgcaataacatgtcatgaatgtgtgactgactggtctgtccttgtgcgagctactacctgctgcctgctatcaatctctctaacaacgggtggacacacacccaccgactgctggttgtcttacacagagaggaaggatccttgcaactatctgggagattaatatgtaaccagcaacctgtgtttgcagccagctgtgggaggtcaaacaaacaaaagcatgcaagcatgtgcggactgaaccgagtgatgcgtgcgagagtacctgcctgggcggacggtcgcactctcttactattga

SEQ ID NO: 8179 - DNA, 464 bp, Homo sapiens
gctttttttttttttttttttttttttttttttttttttttttaaaaaactaaggaaattaattgggttcagggaaaaaaccggaaaaaatggtggaaaaaagtggtaaaaaaaggttaacttaaaaaatacaaaaaataccttggggtaaaattttggaaggggggggtatttaaaaaaaacggaaaaaaaaccaaaacctaaaatattgggaaaacaaaatattaacttttttttttttttaataaaggggggggattgtttttggaataaattaaccaaaaaaataaaggtacccctggtttttttaagggaaaattttttattttaatcaaaccctaaaaaaaccttggtaaggttttatcccattttaaggggggaaaaaaagggctaaaagggggaagggaaaatccttggtgggcaaaacggattatgggggcaaggtaattgaaatggaccccaaa

SEQ ID NO: 8180 - DNA, 448 bp, Homo sapiens
tacagttaccattgtacaatttatgaacacatggattaccttatgacaaagcattatatacaccactgtactagatgatgaagtgctaaccactcacatcactagcatgccttctatttatccaaatatttaaaggtgatatttattgtcgaatgggtggggtggtaccaatggtctctagtatggttagtgtgaaaactataaatatggatctttcagtgagctattagtgagcacctaggggctataagatggtttcacttattaatcacaaaatattcattattatggtgaatgttagatatactctctatgtaaattggttagtaaaacgagttagaagatatgatgaatacaaaaaaaataaaaacagacatgcatgggcggtggaggccatgatcttaaggaaaaaaatgttgtgtgagtcgtgtataacattaaatgaatc

SEQ ID NO: 8181 - DNA, 576 bp, Homo sapiens
caagtaaggggttgtacggtgctgcgaggtcgaatagcataccaatattggttgatctgtctgcaacattagaaatatggagatatatactatttatacatatttaacattaaatatatggggaatatatctttagactcatgaaaaagaataatgtattattatatgcatcatttgtgatatgatatatgactgtgacatgaatatatgaattatttgtaatctgtataaccagtgactgctctgcgaatatcactggtttatcgactgggccagctaggctatgagactacgcaggatcatatggggggcgcgctatgcaaccagccgaaacaagaaccactggagaagtgaggtgatactactcgatgactcgacgaacagctatatgtgaggcgatagtatccagtgcactgacggcttgacaatatgcacgcgaatgtgtccagtgctccaagggcatgacataacataaccagaaagtgtcaggcgggcgcgtagaaaacatgccgacaaatgagactgcacgcgtgcggcttcaaaaattgctgacaactgtgaccgctacctgccggt

SEQ ID NO: 8182 - DNA, 160 bp, Homo sapiens
gacaggggggggggggggggcggggggggggggggggggggggggggggggacgggcagaggggacctattggatgcaaaaaagaatatctatataaaaaaaatatagttgtttttttgtggtttagaaccaccagtaacaatgaaaaagtattcaataa

SEQ ID NO: 8183 - DNA, 208 bp, Homo sapiens
cagttgtcaacaatatttggtaagcaaccagacatgtaaatcttctgtagatgctttgtttttcattatggtgcacctgtacacatttcaagttctgttctgacatgtccattattatcactgtgctctttattgtcaagcatatttttttttaccggtctgtaaactgggatagttatcactttctctttttttatttgtttatttg

SEQ ID NO: 8184 - DNA, 160 bp, Homo sapiens
gaagtcttgtgttttactaatgggaaaaaaaaatacagaaaaaagttttgttactcatggctgccccaccgccagcctgggccctaaaaacagcccagcgcctcacttctggcttgggagaaatatttctttgctccttttgggaattcatggcttgatg

SEQ ID NO: 8185 - DNA, 160 bp, Homo sapiens
gaggtcctgcaaaccatctcaagaccaaaataagcgacccggcctatgtccccctgttattgggattgacccacacggcctctacattggcatgcctagttttgcttgcatctggaaagaaaaagaattgaatcgcacgtttctgggtaaaaaagctggg

SEQ ID NO: 8186 - DNA, 528 bp, Homo sapiens
tttttttttttttttttttttttttttttttttttttttaaaattaaaaaggaattattttttttattgccgggttttattaaagggggattttaaattaattcattggagggggtaaaggaaatggagtgggtgggtgggaaaaggcaggggggccaaaaattattacccattaaaattaaaagtggtttgggtgattggtggggttctggtgggttgggttgggtttttgtttttttgggggtgggttttctggtctttgttcttgaccacttttttaaccattggggttgggggataagaaaaaatttttaggcaaggttgggtattaaaaccacaaaaattttggggggaggaaaattaaatttattgttttaaaggagctttcggggagggggggggtttggtttttgttaccgggaggtgggggggtaggggggttaacacgggtctttttattggaaatttaattctcttaaactttcaaaatggttggcgggggaaaaaaaaaatggccgggagggccag

SEQ ID NO: 8187 - DNA, 384 bp, Homo sapiens
ttttttttttttttttttttttttttttttttttttttttttttttttttttttttttttttttttttttttttttttttttttttttttgggggggcaaaaaatttttttttttttttttggggttggaaaaattttttaagggaatttttggggggggaattttggggataagttttaaaaaaaaaaaaaaaagggggggtaatttttgggaatatttaaggaattaaacaaggtttttatattaattttaggggggggtttaaaaatttatttgggttttaaaaaagggtaccattaaaaaaaattgggattggcttttttagggggacttaaagaatttaagggggtttggggggggggaagggggttatataggggagg

SEQ ID NO: 8188 - DNA, 222 bp, Homo sapiens
cttttttttttttttttttttttttttttttttttttttttttttttttttttttttatggggaaatttacctttttttatttttttttaatattgaaaattttaaaaaaggaattatttttcatttggggtcccggccgggggggggggtaggatcacttgagtaatcaggggggcggtggatggggcgctgaggggagaacacaaacacagggcaggggg

SEQ ID NO: 8189 - DNA, 352 bp, Homo sapiens
tcttggtctaatatagggtatgtgtaatgaactgctagactgtatgcggtacatgaactatactagtgatggggtgctggctgcatattgtgtattactaggtctagttctatgtattaatatgctgcattgtggatatggggcaatatattttttggacgcatctctcttattagtatgatttatagtcctctttcgtgtaatgcaataatgaatatctattattagatggtattatttcttatgacctatatcctgtgactgtctctcttactcctttgtccgcggactgattaggcatggctatgtgtttacgtggctttatttctggggccatcctggcagtgcccct

SEQ ID NO: 8190 - DNA, 160 bp, Homo sapiens
agcttttttttttttttatttttttttttaatgtttgggtgtaaatttattaaaagatttgatttataatatttgtaatggtgactgtcaccttttttcctgccttgctactgatgggattattctgcttaatatattttttattagatgtgcaagttaa

SEQ ID NO: 8191 - DNA, 160 bp, Homo sapiens
tactgacatgcatgtactaactagggtctatggcatgacttgcataggctattacatgctgagttggtagcattagactgcatggtatcataataattgaacacaatgctgatgaagaatattatctcgtggtagttagtatatttataggcaagtggga

SEQ ID NO: 8192 - DNA, 480 bp, Homo sapiens
tacaagctttttttttttttttttttttttttttacaagctttttttttttttttttttttttttttttttttttttttttttaaaatatttttatttttattattttggtattaattaaaaatatgaaaaaaaaagtaaaaggggttcctttttggggggaggccaccttgatggcttaaaacaagcttaataaatcgaaaaaaaaaatgggatgccaaaagatggggggggaaaaagggcttgggggttaaaaggcgaaaaagttgggttagggggttgggggggggtaacagagggaaaaaaaaattcagtttaggggaccctaaggggacgggggggggggggggggtgagggacacttggaagggtttttggagggggattggggggggagggtttttgttattgggggagatccgggagggaggggcggggcagggtgggggtccagtggggtaaattttcttaagggcataaa

SEQ ID NO: 8193 - DNA, 240 bp, Homo sapiens
tagagcttttttttttttttttttttttttttttttttaataggttaaaaaaaaatttttattttttttaaggggtgttaaaaattggaataaagaatatgtataatatttgttagtggggggggtttggtgtaatgattgaatatataggaggatgaaagatatttggttgtaaatagataaaattgggagggaaggtggaggggaaagggggaattttaaaaagatatattaaaaaat

SEQ ID NO: 8194 - DNA, 224 bp, Homo sapiens
tattacatggcacgaggacccactgagaacacaacgcctgttgcggaacaagaacacggaatggggctaacaacagactaagtactttattgttaggcggataatatataactcatttggacaggcctgggccatatctctgactatgccctatattggatgcctggcaggggcccaagcccaagaggattctttaccctcggaacagctccccaggcactcag

SEQ ID NO: 8195 - DNA, 192 bp, Homo sapiens
ctaagattgataatttgtgtatgtgatataaacgttttattaccagatgtgtacatttaatgagctatcatttacattataaaggttgtgtgattctttgtattttttaaacacaatttttatattcaaatctgttggagcaatgaaaagatggagagcataaacaggtttttctatgctgatagaccatgg

SEQ ID NO: 8196 - DNA, 288 bp, Homo sapiens
tgatgaaagccaaattgacgcaggatatgaacctgttttgtattgtgataaggttaatattgtgtgcaattttggtgaaatgagagaaaagattgatcgtggttttggttgaaagatggatgatggtgcttgattgttggatgatggggatgatgacattgatgatatggctggtggaaagctgatgtgtggtgatagattcttaaactatggagatgctggtattgttgatgtgggtgatgtgaaacagatgagtgttgagagtgtcataaaatatagaggattaga

SEQ ID NO: 8197 - DNA, 304 bp, Homo sapiens
tttgatttttttgaaatatgttgatatgataatttatgatataatttggaggatagttggttatttttaattttataattacaaaaatattgtaaaaatttgtgtttagtatacatttttaatagttgtatgaaaggtgtatatgaatattataatgaaacatgttagtaagtgtaattaagaatgatatgaatatattttgtgttaatgatataaagaaatatgggattgatatttaaatgaaaatgtttgtattaaggataataatgataaatgttttaaattaatttactttaaaaaatta

SEQ ID NO: 8198 - DNA, 240 bp, Homo sapiens
tcgtgctaatggtggttctgaatgcaatatttgaatattaaatttaaatctatatattattatggaacataatttatatggggaatatattataagactcataactgaaataagtatgtataataaaaagaatatgtgtaatgataatgaatatctattaatatatagtatcagttataagttttatattatgtgagtgtcttaattaattattggttgtctgagtgatttaggcgacgt

SEQ ID NO: 8199 - DNA, 224 bp, Homo sapiens
agttgtatttaaaaaagcataagtatagattgtgttgggtagaaggagaggagaatgagttgatttgttgaagaggagggtgtttgtggatgaagaggagtaagagttgaaagtagaaagttgaatagatagggaagtgttgtgagtaaggaaaagtaaggaaaaggattcattataagagaaaatgttactgagtgaattaataatatgtaagtttggtttca

SEQ ID NO: 8200 - DNA, 704 bp, Homo sapiens
caagctttttttttttttttttttttttttttttggttttgaacctttaataaaagtaaaaaatgaatgcaaaaagaacacaatgttgaaaacttagtatgaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcactcgctgctttcatctaataacttctggtttttcataaaatgctgacatcttcattggaaatttttttcatgtaactgttttcattttcagaaaatatataagggggtcattcccaagttcagaatgatcctatttttttaaaaaacaaaattcctgtaaaacaaattaactccaggaacttaaaatttactccaagacatttccctcaaaacaaagcaaaaaacccagccaagatcgttacatcacaaaaccaaacacaaagaacagcgctcacaggcaagttcctctaagctttcattctgctgactggtggcttccattttaaaggagtctttttatccagccactttcacagaattttataac

SEQ ID NO: 8201 - DNA, 576 bp, Homo sapiens
atgagtgaagataaaatgaccagcagaggaatgcatgtctggtttcagagttgcaggttattatcctgaaccatacatgaacatcataagcgtgagtgtgatgaactgtatcggatagctacaaagcgcacattagaatgcgagtttgatgagttgaaaggaaaaatagattgccggtctgggtagtagttggaagatggttctaaattcttgaattctggtgatgatgactatgttgatatggttatttgggagatattgtgtgttaagagtttatcaaattattcttctttaggtcgatttgcgggtcatgatattaaatatatagtagtagatggtgtaatcataagtagcggaatacagtgatggtggaactggatacgttcgcaactctgctcataaagctcagatagctgaatgaatagtatcacttataggtgcccactaagtcttaatcattggtgagataacaggcgtagaattgtttgtttcatttgggattctatgtatagttataaatgaatggataatgatcacaatgtgtcgtataagcattatagcgagaagagagatgtc

SEQ ID NO: 8202 - DNA, 368 bp, Homo sapiens
ctcatgcaagtgataggtggaactgtcgcctgcagctaaaacagggaagcggaataagatgctgatgctgtgtcgaggtcgatgagcatcctggtagtggtggctgtgcctgcaatatttgaattttaaatctaaatctttttatttatatttaacattattgatatggggaatatatttttatacttatcattaatatatatatttataatttctgcttttgggtaatgaatatgtatatctatttatatttgttttatttattatttctatttactgtgactgtctcacttttttctttggtttctgtctgattagggttgggtatgtgatggcttagttttatggtcagggccgaattggcaggc

SEQ ID NO: 8203 - DNA, 672 bp, Homo sapiens
tttttttttttttttttttttttttttggttttgaacctttaataaaagtaaaaaatgaatggaaaaagaacacaatggtgaaaacttaatatgaatgcgaaccttacttgatggtcaaatctggtagagtgcaaattttggtcatactattttacatttttacaaactcaaatcactttgggtcatatattttctataaactattggcaaaaaaatcctcaaatttacattcttttgggtacattatttctaacagatatagatttacttccgggttcggagagaaagacttattgggtgtgcgtgatcaagtctggtttaaagattcactcgctggtttcatctaataacttctggtttttcataaaatggtgacatcttcattggaaatttttttcatggaactggtttcattttcagaaaatatataaggggggcattccaaagatcagaatgatcctatttttttaaaaaacaaaattcctgtaaaacaaattaactccaggaacttaaaatttactccaagacattttcctcaaaacaaagcaaaaaaacccaacaaagatcgctatatcacaaaaccaaacacaaagaccagcgctcacagggaagttcctcttaactttcattctgctgactggggggcttcatttaaaaagggtgttttaatg

SEQ ID NO: 8204 - DNA, 288 bp, Homo sapiens
  misc_feature (1)...(288): n = A,T,C or G
catgagtccgcncagtgcggtaaaaattgntggaaaatctgacctgtggagtgccttacatatgtacttgaatagaagtggtcaataagattgattgcatactgcattggaaaaagacataaagaatgcttgacctatctatttatcctctctcatgatgtcttcgtntagaaaagttaaatatgctgttataagctcatagtttgcaattgcggatagtctcatgagagcttgatggatgaaggctagtaatctgtggtataagccatctggggaacgaggacagga

SEQ ID NO: 8205 - DNA, 160 bp, Homo sapiens
actgctgaacctttttatgttggttacttgtctatatatgctatcttttggtagtctttgctagcttttgatattgtgactgacaaaggtctgtggagtgtctatgagctccagcgtgacaacactgcctgctggcagcttggccagtgctcactcaaaa

SEQ ID NO: 8206 - DNA, 255 bp, Homo sapiens
  misc_feature (1)...(255): n = A,T,C or G
cagcttttttttttttttttttttttttttttttttttattttttaaaacaagcaaatttttattaaaggaaaaattttgcgagttttaaggtttgcgaggtgtaaattttgtgagggtgaaaaggtttactttttcacncagtctgtttctggcatgtcttttaatggatgtcagaagtccacctggtatcaatgtatatgccagtggtgcacactcttgtagttattttcccgcatgtctgtgcgccagtttt

SEQ ID NO: 8207 - DNA, 192 bp, Homo sapiens
  misc_feature (1)...(192): n = A,T,C or G
tgttcgtgcggacaagnttgtggcgtacagcaaaaagcacccaccaaggcaagacagctgacttcatctgctcatntgtattatcctgcaaccatcctagtgcaaataaagcgccggactatgacctgctggtattgggattgagcacacgtgtctcacattgatatgtcaagtgttgactgaggctgagag

SEQ ID NO: 8208 - DNA, 224 bp, Homo sapiens
ttcccctttttttttttttttttttttttttttagggttttattttaaatgggaagggaaaaattaaaagttaagggaacattaaagtggaaaaaaaaagggaaacacttaaccccaacttttttgaaaaagaaaaaatgatgggggggggagaaaaggtaaggggggaaaaagggtatggggggattggggggggggggacgtgggaggaaaggggagggagg

SEQ ID NO: 8209 - DNA, 752 bp, Homo sapiens
ttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggttgtgtctagatgagttagggacagtcataaaagctggggatatgtcgcatttgcaatcagtagtagcatatttccagaatatgagccataaggtgcagtcctgaatacaacagtgttatccatagaaaggagctttctgacaaatatacatagccttactaatgagtacccctgcgccctccctcccaccgcacct

SEQ ID NO: 8210 - DNA, 368 bp, Homo sapiens
ttttttttttttttttttttttttttggttatttctatttttttttgtctttttgtataggctaatttgtcggatttggggatgagatattgaagggttgaaaggattatatactgtattggtggttggttggttggttgttgggctgggggaaggggggggaggtgggaaattaattaataaaatagtaataaggtcttagataaatattatagttaaagggaggaggggggggggtagggggataaaggggcaattgtgaaggggggatgggtggatgtttttgtggagctgtgggagtgaggatgttaaaatgatttatttttataggtaggagggtgggggggtggtgggtgttacgtggcggg

SEQ ID NO: 8211 - DNA, 690 bp, Homo sapiens
atgtggtgtgtggtggacacaaagttcatttttattttctttttcctttattttttcttatggtgaatgatggaagattaccgattaattacacatggcacatggataatggatgttggctgtcatattcaattgcaatttgttatagtgctgtgtgattaagtattgtttattgactattatttattctatatggtatataagaaggaagcaggaatgttagctgatgacacgtgaatatttattatacatgctgtgtgctgcgtccatgttgattgcttatgacgtatggcgtatggaacatttttaagtcattcttgatggtagctgatacctgatctgtgtgttgagttatcctgtatgtggatcatattttaaactggattacgtgttactggtttgggtgtgggttgtgaaccacaccagagatcactaaacttgcttcaggtttagtatctgactggtgtatggattcttaagcgccataagtcatttgagtatttgattatctgaataataacatgcaaattagcaagaactgggcatacagggtaagcggcaaggacaataaggatttttgtagatattatatattttttgtttttggttaaggagacaagtttgaagagcagacaaaatctcttttttaatatagtatgaatgagaatacttaaaaaaatttaaaaaata

SEQ ID NO: 8212 - DNA, 370 bp, Homo sapiens
ggtacatttttatttttttttggttgatgttgtttgtctttgaatgaagcatgtaatttattctcttaaagaggagaatacatgtggatctttagaaagtaggaggacatgtctaacatagatcgcttgtgtatattttagtctataactgatcatgcattacttagctgggcgtggtggctcatgcatgtattctgaccttctggggcaactgacgctggataatatttaatacctggatagtggatgatgcagtgagccacaatcacgccaatgcactccaacctgcgtgacagaccgagactatgtgtaaacatctacttcaaatatatgggcctggatgaatttaaatccgtggatggcgacgtac

SEQ ID NO: 8213 - DNA, 162 bp, Homo sapiens
tactcttccaattaatatctacattgatattcaccagatattgtgaactgataacactgaaataataagaattgcatagtatttgaagctgcatatcaataacagctttcttggtaatggctcctaatctatcttctttatggtgtggtctgcctcatattc

SEQ ID NO: 8214 - DNA, 178 bp, Homo sapiens
gatagggaaaagttagattattggaagattgtgtatacttattgatgaatatgatattaaaaatggggatgtagataaagaagaattgtgatttgaatgagaatattgagaatggattattgtattgagcttttagtgtttttttatttaataatggaaaataagctgttgtttagag

SEQ ID NO: 8215 - DNA, 498 bp, Homo sapiens
gtaccattttgcagcggagggcatgatggaaggacaagcgtttagaaagtatgtatctactctgtgatcggatattggtatgtaaggagtgctgctgtaactggaaccataagagggattatgcttacacaatgatctcatggatatgtgttgttagcatgagctgtggatgtaggattgtgtgctagaggaacgggtggagagattcttcaagctatggtgaatgatagagataatatatctgtatggcagaatatggacggcagaaagtatttctatatgacaatgattatttgctatgtatagatggtgacattattgcaatgaagctaggacgtgagcacgctaatcactaatgaatacgggattggctgcagcttgaccgtatgagataggtcccaacgtggcggatgcatagattgagtatttgtatgtgttatatagatagctaggtgtaatgatggatataggtgatagtgggtgaatatgttattcgct

SEQ ID NO: 8216 - DNA, 550 bp, Homo sapiens
  misc_feature (1)...(550): n = A,T,C or G
caacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttangaagattcttccctatcagttaaaaagtttagaagaagaatgtgaatcctctctttgcacatctgcgttaagagccaggaatctagagctgtcccaagacatgaaaaaaatgacagctgtgtttgagaagctgcagacttacatagctcttcttgccttgccaagtacctcgggcgcgaccacgctaatcactagt

SEQ ID NO: 8217 - DNA, 162 bp, Homo sapiens
  misc_feature (1)...(162): n = A,T,C or G
gctgggcacgtaaggtnacgttggtgaatatctctaactcacggcatngtatatgcaggtattttcggtaccaaggacaaggttctaagtcatactattaaaggctaataaaattcaaaaatggtttaaagaattcgaacattttgaatgacgcagagggct

SEQ ID NO: 8218 - DNA, 530 bp, Homo sapiens
  misc_feature (1)...(530): n = A,T,C or G
ggnccgagtcaagcctgcgtatcagaatctgagacagcgtgttgacaactttgttgcaaatcacttggcaactcacacatggagtccgcatctcaataagaaccagctaagaaacaacattagacaacaagtcctcaaatcangaatgttggagtctggtattgaccgaattatttctcangttgtggacccaaagatcaaccacacattcagacctcaggtagagaaagctgtgcatgagtttttggccacgctaaatcacaaangagaangaagtggcaacacagctcccgatgatgagaaaccaggcacttcccttattacacaaagtgttcctactcctgggcccagtgctaatgtagccaatgatgccatgtcgatattggaaaccataacttctcttaaccaagaagccagtgctgctanggcttcaacagaaacatcaaatgccaagaccagtgagagagcgtcaaaaaaacttacatctcatccaaccactgatactaataaccctgccggcggggggtgga

SEQ ID NO: 8219 - DNA, 242 bp, Homo sapiens
gtccggggatgcacgcatgatggctggtggtggtatgttgaaaggataaaccacagccaaatgaaaacactattgatacaggttatggcgacgctgatataagtaaagacagacagcagggcacatgacacgacatacacacagcatggacggcaagcaggaatacagatctgattactgagatgtgccattattgatgtcaagaaggttcacatgatacagtgtatgagtgaaggtctcat

SEQ ID NO: 8220 - DNA, 290 bp, Homo sapiens
acatgatataagagaaatgttcctatggtatatatgaactcctaacactatgatcgtttttttttttttaaatgtgggtattggtgtgttttattttttgctgtttacttcttaactgaagacttgttgcgttgtaaaactgtttaataaaatatatggcattaacttgtatttacaaaaaaataaaagacaggctttacactatttctagggggacactatttcgggaatgttatgtaaaactctctatctagccattgggaccgatatcagttgattgggtatcgtct

SEQ ID NO: 8221 - DNA, 242 bp, Homo sapiens
aacaactccaggtgcaagtgaacaggaataaaaatgccatcgtttttactaatgaatttcacaaacatatataagcgaaataacaatggcagatgcctccactgtacttgagcaagtcatcactgatctgtttggagaaattagtggtgatgtcggtgctggctgtggcctgtttctgtctgattgtgaaataggtaggcctggttatgtactggtgtgtaactccaggtaacggcatattt

SEQ ID NO: 8222 - DNA, 178 bp, Homo sapiens
gttttatgcttgtgggttttttttttctctgatctaggtattaactaccaaataattcaaaacaccaaagaaatcatttgaatgggagaaggagaaacaggttgaagcactgacaatttttgcaagtgagaattcaaggactgtattgtagccacagttatgtacattatctacgaac

SEQ ID NO: 8223 - DNA, 354 bp, Homo sapiens
cactatattggccaggcttggatatatgaaacttgtgtcacttaaaactaaggcggtgtgtgatattaaaagaggtcttttacatctgtgttagctggcttgagaactcgcaactttgactatcttgaatgtgctgctggatggatggcctttgctctgattaggatccccatggtgaaccctgtgcccacagatggatccggatgcagtgcacttgtcgttaatggagctcgtctgaatgcataggagatgtggttcacacaacagtgcaagaaacctacggcctaggtgaggggaatccacttgcgcacagtgtcctctatctcacacccttgctcgacgactgcacagcat

SEQ ID NO: 8224 - DNA, 450 bp, Homo sapiens
  misc_feature (1)...(450): n = A,T,C or G
gttccagcactgagggaagactcagtctctgccatcacatacacctcatcactaagaagagacacatgaaataattaccatccagtgtgataagtgctctgacagaggatggagtgaggactagtcaccttggggaagacagagaagcaaggtcccaccaagagatgagaagccagcctccangagtgcgctatctgagagggcaagagaaagaaggcaaaggagacgggtccatacttgaacaacttgaaataacttgtctgcatttcaagaacaacctaccacagaccttacctgtcaccttggctctcccacccaatggagatggctctaatggtggcacaaaccanggaagggaaatctgtggtttaaattctttatgcctcatcctctgagtgctgaaaggctgctgtnagctgtatgctgttaatgctaattgggatagggggt

SEQ ID NO: 8225 - DNA, 178 bp, Homo sapiens
aggggtaggaagtgaggtgtatggatatggaaatgtaatgaggtggtaagtaataggaaatttaaaggggaaggtgaaatgagttaggatgtttgtggatgagaagaatgttatagatatttatgatttgtagtgggaagttattgtattgttatattaattttataatagttatggt

SEQ ID NO: 8226 - DNA, 514 bp, Homo sapiens
ggtggcggagcttgaggtaatggtgaaggggtttgtgtgtctttgagagatagagattaatacatctatttataaaatataatcaattagttaatataatattgattaatgttaagtttgttacgtaatttttgtttattatgattttattagaatatatgaaaacttataagattataatgaagaatgaaaagatttaaggttattacatgatgacgggagttgtgatgagtctttttcatggaatggaagatgtattgaaaagtaatattgagagaaaggactgcagagacaagaattaataccaataggaaggcagtgctttgaaattataatgaatgtgagtgaatgagcttaaagtataattgaagagttgttagtgattaaaataattagaaggcgatcgtttgtgatgagatttaatcgaaagtgattattagaaattgaaaatacgtgaagagtggtgtattgagtttgttaaaacgttaagttaacgcattttagttataagcta

SEQ ID NO: 8227 - DNA, 162 bp, Homo sapiens
ggctcgctggacgcgcaggttactatggtgacttaatgtaattctaatgtactacatttataaattttggctatatgaatgtatcatcaatggaaatcgcatatctgtcaaggatctgctctttgctaatgaaaagtggtagagcaatggaacgagcgcttg

SEQ ID NO: 8228 - DNA, 290 bp, Homo sapiens
caggtaccggagttggatccggctgctagctacacggagtgtagggacactcaaggctcttacatgcgggaaccgagcacatcatcatgctgggtactttctggccacatcggagactctgacaattacttgatgctatgatctgactgaagacatgaagtaagaggtcactgtgactaaatatccagaagcctggaaggaggggccgggagctctcaagaatgggggacaagatggccacatgagggcagctctgtgccatatcggcacaaggcggaagaaagaccaag

SEQ ID NO: 8229 - DNA, 178 bp, Homo sapiens
aggtacataaaaacgctgctgggtagaggtcctgtggtgacagagtcaaaagactgcaatgttgatgtcacccggtgaactcctggtttgtgagagtgcatcgggattcaatatcatggaccttaatggagtaattggaagacctcaataaggaaaccattgagcctatggaaggttt

SEQ ID NO: 8230 - DNA, 370 bp, Homo sapiens
acaatatggttcgttcttttatatcgaaaaaagtgtaacttaaaaaaagtttatttatcgtataaaaataagtcttttacatctgttgttagctggtagtgaaaacttgaaagactcagactcagtggtaaacaggatgaatggtcccacctcgcctttccgtttgggagagggatcttgagggctgggacccctctgcgtcacagtaggttgagtgcgttgctggggcagcaggtttctaaaattttggccttcaaggcaaagccatagcaggggatggggtttcagcacaaccagtggcaagaaaagactaggggccctcggctgatgggaaatccaccttgtgcaccagcggttcctcacaactcaa

SEQ ID NO: 8231 - DNA, 178 bp, Homo sapiens
ttctagggtaaaggaaatatcataaaaactaaatataagcagaagctcaagggatctatgtatgaaagtgctgggagaataaaagttatggaagaggaggaaattctgaatcaaacacagattctttggtttctgggcaggattataagtgtgtatagagtgggaagaagctcatatg

SEQ ID NO: 8232 - DNA, 210 bp, Homo sapiens
  misc_feature (1)...(210): n = A,T,C or G
tatggntcagntcttttatatcgcaaaaaggtgtaacttaacaaaaaggttaatttattcgtattaaaaaaaagntctttttacatcctgntgnttaggctgggtggtgtaaaaacttgnaagcaactcagcacctcagatgggtaaacagnatggaatggttccaccctcgtcttttccttttggcagcaggatcgttgnagggctggc

SEQ ID NO: 8233 - DNA, 194 bp, Homo sapiens
  misc_feature (1)...(194): n = A,T,C or G
atactcgggnggnatggnggnctccatccggncctcgcggtccaccttccatcagatgtggtatcancaagacagnagtaggacgagtccggccccctccatcgtccaccgcaaatgcttctaggcggnacgtatgacttaagttgcgtttacacaccttttcttggacaaaaacctaactttgtcgcagnaat

SEQ ID NO: 8234 - DNA, 242 bp, Homo sapiens
  misc_feature (1)...(242): n = A,T,C or G
tcggagtctgntagcgaggtaaaatacgnacccagtaaaattgtcaatagccagtgtcttgtaattgttttggtttcggnttgttttctattagtacttatggtcagtctccggctgtattgcatacctcctgcatgcgtaggtaattacggtatgtgttttagtggagctgggtactttctaggggattttagtcgggggtgtatgtcctttgttgggggctcagctgctcctccctagtt

SEQ ID NO: 8235 - DNA, 242 bp, Homo sapiens
  misc_feature (1)...(242): n = A,T,C or G
ggtacaagagagtcatggaaagtatttgaacttgaacttaatagcgatattattaatgtgtgtgtggcgcacaatcttggcctcaaaaggtcatggataacctgagcatgctcttattacataactggttagacaatacgaccgttcatatacactgcttgctgtatccacggaaagcacacctgtcgcacaatgctctgaaacagctacttcacgttgtgctggacagctgaagangtgtc

SEQ ID NO: 8236 - DNA, 162 bp, Homo sapiens
agtacaattatatggccccagggatattgcggagggatgggtttaaaaaagtctttcggatataagaaagaacataggatgaaatgagtggtggagaaagggttacctatagaagactaattattcaaatacttcctctatctatagtatagtatattcata

SEQ ID NO: 8237 - DNA, 226 bp, Homo sapiens
gtgtacaggctggacacgatgatggatcacaggcgctggatccacgtgtaagccaggacgctcagaacaggcttggcgagggcgtggatgtgctcgcgatgtacgacaagcaccaggactcagagtgcataatcagcgtgcagacacatcgcacagtgcatgcttccggagtggagtaggactgccacatatgggagatcaaagatggcactgaagtaagcgaaca

SEQ ID NO: 8238 - DNA, 194 bp, Homo sapiens
gagtatttggggaacacatgtctaatgaatgccatccttgagtctctcataatcattgatcagtcatgctgttatctcatgcaactgcccgccgaggtagctaagaatgggttaacagcgagcagggcagacataccatgcctggatccaatgggataacaatgtttatttggcagactaattttactaagata

SEQ ID NO: 8239 - DNA, 258 bp, Homo sapiens
gtataaaaaattggagatgtagggggttgtagttgatgtattattatttgattttatattataatattctatttggtgttatataaattgatggggaggtgttttttaaatatttaaatttaggtttggattgattatgtttatttgtgagttgtgattatttttgagttgtgaagttttgtaatatttagtggtggagatggtgttttggtatgtgaatattagcttgtgtgggataaggtggagaatgtggttgta

SEQ ID NO: 8240 - DNA, 290 bp, Homo sapiens
caacctttttttttttttttttttttttttttttggtttttaaggggggggggccacaatggttaaaaaggaccttgggaaacagggaacgaaaaaaatggttttaacaaaatttgggaaccaaagtaaaatgggataatgggggttgggaagaagggaattggtttggtgggagccggctttgggctcccaattccttttttttgtcctttggctggggttagggaaaggggggaggcaaagggcaaagctccacccctgggtattaaaaaacggcagaacaaacatgt

SEQ ID NO: 8241 - DNA, 290 bp, Homo sapiens
  misc_feature (1)...(290): n = A,T,C or G
acatagattatctgggcgtggtggtctgtgtctgtgtaataccagctacttgtnaagtgtaggtgggatgatcaactgatccaaggaggacaaataggtgacaatgagctgtgatattaacactgaaatgcaaccggagctgcatgtgaacctggttgaatatacataaataaagattgctgcaccattggatgaagataggtgatttcatatatgacttgcggccagatgcagtaggaaacatatatctgtgacacgattctacggagatgactggagggagagtacgt

SEQ ID NO: 8242 - DNA, 162 bp, Homo sapiens
tactgtgttgaacttcattattcaatgtcattctatgtcataataacagaaaaccctatacaatcagagttgctcaatactggaccttcatgcaatactaggaaccgttacgctggtgcattgatacacgcacaccatacgagtcacaatgccaaatggaaa

SEQ ID NO: 8243 - DNA, 210 bp, Homo sapiens
gggaccgcagggtgcactacaacctacgaactacgcgcaccaccaactaccaccagctggtcgaacagacgcaagtatcatcacaagcatggtatacaacactgctcctgcgcacgaacacctctggagggacaccatgctgtatgctgctaggctagtctagtatcctgggatattcaatccacttaatctgagttatttagcaagtcc

SEQ ID NO: 8244 - DNA, 242 bp, Homo sapiens
tactcactatcggtgctggaatcagtttcatagaatgactagctaatagctgcaggtggctataaaagaaaggaatgtgcaacaaaggaaatgaatgatgtatatctacatatgataacactgacagcttgtgtaggtaccatggagaacagccgaataggctgatgtgaagatggtctgtgtagggctaaaatgactaagtaatgtgtattgtcaaggtatgttccaatacagtataacag

SEQ ID NO: 8245 - DNA, 178 bp, Homo sapiens
gtacacaggatatagacaataggaaaataatacctcggtcattaacaacacatatagaaggacaccagctgtatcgtgctggctatcacctacctgtatataattacttatctggtataagctgacaacatagaccttaagtgtaggtgggcaatgatgctaggaatctgtggaaggt

SEQ ID NO: 8246 - DNA, 162 bp, Homo sapiens
gtctggacaattcactgagctcgttctctctctctctctctgtgtgtgtgtgtgtgtgtgtgtgtgtgtgtgtgtgtgtatctggctttatgttgcattctttcccattgggccactgttctgtgccaacatgcaacgcaataatctgttacccacattcag

SEQ ID NO: 8247 - DNA, 306 bp, Homo sapiens
tacatgatggaaaggaagaatggacgacgatgcacgacgctgatgaaggcacagataatgacgaggacgaagtggggggacgaacgagggagatggatggtcactagaatagtatgacccctgtggtgggcgaacgagcgagattgacagacatcacagccgcatgcactctgcagtggcaacagatggaggctcaacagcattaaccacgccaagcctcgggcatgtaccagccggaggtgactcaggtgcataagacagcccacagttgaggcgatgacgtgggggaagagcacaagcgagaaa

SEQ ID NO: 8248 - DNA, 600 bp, Homo sapiens
gccggtaccataaagaaagtaggattaaaatctaaaaagacccccaaagcttttcaaaacctgatctgagaattagataagaatatgtcacttagaaagacaagcctgtagcacccatagctctgattaacctgaaagcatcaagtgactccctctttttccaccctaccaacatcactctaattatacttccaattagaaaaataatgtagcatttccctggcagtagagattaaatatgagttcaggaatcagctcctccaaacatgcataaatgaggacaaggagaagccagtcactcctgactgcacggtcaagtgtgtgggcagttgaaattaaggtaaaaacagtgaggctgaacaaaatcacattaagaaaaagcatctcatgaggcttttcgaggtcagttgatgaaggccagataggagtcaatattttctcatataccccagctgttaccactattcatattccaacagcctccagattgctcgaggccacctggttgacttttaccttggagtcggtccagaaaagcattatttacccttgtgatattgtcctcacagtacctcggccgcgaccacgctaatcactagt

SEQ ID NO: 8249 - DNA, 434 bp, Homo sapiens
caggtaccactatttgttggagatattgcacagtggaaaatgacataatcatggatatgctatggtgtacgctgtatatacagttgaaaactatggagttcgaaatgttgggggagaatgtgatatgagaaaaaagatatacatgtggtaagaacctctaacaaggttaatgtgcatgcgcgaaggctcatgaaagatcagtgtgtaaattggcttatagcttatacaaaaaaaaaaagaaataaaaaaaaaaatgacctcggatcgcgaccgcgctaatcactatgtgaattgacggccgcctgcgcgatccaccatatgggcatagctaccaacgcgcaggatgcatagattgagtattctatagtgtaacctggataggttggcgtaaatgtggtcgtatgctgtggctgagagacaattgtatccactcc

SEQ ID NO: 8250 - DNA, 258 bp, Homo sapiens
ggacgagctccagtatatttcgtagataaggcacagatgaaaatgacatagtcatccattgctatgagtgtaagcagtctgtacaatgaaaactatggatgttaaatgatgaggaaaatgccatgcgagaaagagagacatgtgaaactaacagctgacaaaggtaatgtgcatgaccgaggtgatgggagacttcagggtgtatattaccttctacataatagaaaacaaaagaaaggaaaaaaaacaaatacttgg

SEQ ID NO: 8251 - DNA, 434 bp, Homo sapiens
gcaggtgcaagggcatggtgctgagggggcagggggaggctgaggcagccgaaaacgcattatttttctctttgaatgataaagataaatacaactacatatacaatataaacattaggaaactgagacaaagataatggttaaggttataacgtaatcgtaatagcaaaagattataatagaaaaaaagaatacgaagactagtaacatgaggaaggagaaggaaaagagaaaatgaaacatgaccgtggctgaggtgaagatgattcatggagaaggaaatgtatatgaaagaaaattgagagagaggaatacggagacacgaaccaataccaatacaagggcaatggttttgcattaagatgaaggtgacggagacagataaaggctaagtttaaaagtggaagttgatgaaaataatagtaaggggatgt

SEQ ID NO: 8252 - DNA, 162 bp, Homo sapiens
cgtaggtacggccctccccctgtatgcctcttcgtggcagtaagcatggaatattgtaaatggtaggactccagtaattccttccagtggctctactatcaggctaggctcaggtataacccaggttatggcatattcgtaggtagctgctctctatgtctc

SEQ ID NO: 8253 - DNA, 546 bp, Homo sapiens
  misc_feature (1)...(546): n = A,T,C or G
ggcaggtgaaggacctgtttatctctgatttctggagttcagcnactagaaaccatcaatagatgtctcacaaaacatctggaacaactgaagacccctgtggggactctttcagacatctttggaaacctgcatcttgactcattgccagaggagtcagatgtggccactgattctatcccaagagagatcttggtcacaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggaagggaaacggagtattcgcggggagccctaccatcttttacatgctccattgtgggacggccttgtacctcgggcgcgaccacgcctatcactagggaattcccgggggcctggcggtcggaccatttggggagag

SEQ ID NO: 8254 - DNA, 530 bp, Homo sapiens
  misc_feature (1)...(530): n = A,T,C or G
ccngggtgtaacatgccataccatgacccataacaggggccatgcacacccatcagtgaggaccttcggcctagccatgggacttcagtctaactatgtgacgctactcatactaggtatagtaactaacacaatgactatataccaatgaagacacgatgtaacactgaagagcagatgccaaaggcacaagacaacaccagtgcaaaaaggcaccagatgcgggataatgctatcgattacgtgagatgttatttatttcgcaagatgtttctgagtctgttagcactccatgatagtctctacactccaaccaagagggcactggccaactacgagggtaacggcgctcaacacgctagaagccgcactactaaacacatgcgcaacacttgcataaagaggatcaaccagcagagcgaaccatagtcaaatgagaaaaacacgaaaccatacaatacaagcgctgcttaacacaataagaccgggtcattacaataccactgtgcatgcatcatagcctcccgaca

SEQ ID NO: 8255 - DNA, 274 bp, Homo sapiens
cgggcaggtactcaccgtgcgtgacactcaagcctgacttaacacagtgcatgtcatctgatctacaagaagatacagaactggaaatgaaaagacatgtggcggactatcgggcaatggtggaattgcataacgaacctgtctagtgagtctagcgtgatgctccataatgatgcacacttggtgcatcatagaggtgtaagcaggaaccaagaaccagccagcagtgtctacactttgtgattggacacttgggccggggaacacgcctcta

SEQ ID NO: 8256 - DNA, 418 bp, Homo sapiens
agcccccccccccccccaccccggccccccaaaccaccaaatgaagggcacgggaggaggacacacaacacgcccagacacacagcacagcaggggccgcgaaacggagacaaccccccccccacggccccgagaagaaaaacaccacgcccccccccacgaacaccaccaaaaaaaaacaaaccccccacaacaccccccgggacccacagcccaagagaacccaccggagaaccaacaaccggggggaggcggaggcaggccccggggagcagggaggaaagcggacagccaggggaggccgcgacacccccgcccccgccgggaaaggcaggcggcggcaagcagcaacaaggggacagaagggggggcaggagcggccgggagccccccagcaaaaccaaccacaaattccggg

SEQ ID NO: 8257 - DNA, 450 bp, Homo sapiens
ggtaatatgatgaataataaagatgatgcaaacacagaacatacttagtcagacatagatgagtacagatagatgttgaggtggctggggagtcctgagtggggatgttggagaatgggaatacgaaacagcatgctctaataatggacacactgggagagatgcaactaagggttacagactgcaagatgagacaacaatgagccagcgtacacacaaaagatataagaggaacacgctacagaaatcaagcaataagatgaaaaagatagggtacaaaccacacacattaacaaaagtggctacaactgggaggaatggagacaagaggctgtatctgggtgctaaggtgacaagatgcaaggagagggaagtcacatgcaatgatggaaaggacagagagaccacgctgatggtggctatggactgggtaccaccatgatcgtagct

SEQ ID NO: 8258 - DNA, 162 bp, Homo sapiens
ggggacaggatacggaggagaactcaatagcatggtcactggtgtaaattctgcattgtagatacacgaagcagcctttacctattactggagcctgccttcactaacaataaatgaaaaagctgctatgcacttctacagcaggctctgggattgtcatat

SEQ ID NO: 8259 - DNA, 178 bp, Homo sapiens
gtaccattggtggccaattgatttgttggtaagggagggatcgttgaacttatttgatatggaccggtagcgtagggctggggacggggacgaggagcacgatgtaggtagggacgatacatcataccgcttctatttgctgcacgactgaccatgatagtactagccaagtgatggt

SEQ ID NO: 8260 - DNA, 594 bp, Homo sapiens
aggtacacctaagttcacatgaagttgtttcttcccaggtcctaaagagcaagcctaactcaagccattggcacacaggcattagacagaaagctggaagttgaaatggtaagtgaaactgtatccaagtaagcaggtaactgggcaaacttcctacggcacaaatggctttttagttacctcctagtgctgaatgcattaaataaatggcggattcttgtcttgttatgattaataagaaagtttgtaaatgcagcctggatgatgataagcaaatgctgactgaacatgaaggtcttaattagctctaactgactaaaggcatttgttagttttggcaggggatgaacactcatctgtggctattctaagaccactcttatttcttatgtggagtccaacttgcctggaccagcttaatggttctggtaagttttaatgaaaacagtagatagacttaatgaaaatgctgatggtgatatgcttactgctgagctaatggcttaaagcttggctgatgaatactgactgtattttccttgagcatgtgtggaacagcggttatgtgttctccttgaccgtggttgggacggg

SEQ ID NO: 8261 - DNA, 674 bp, Homo sapiens
gtaccttgagaggtgtcgttaactttccttgttaacgaaaacagtatatcacattttcttgctgattaaagttattaattcagagactgaaggggctggacttgctacctgtatagaactgtgtgtaaaggctcttcgcttggagtctacagaaaatactgaagtgaaaatatctatttgcatgaccattttatgtttgttgcctgatgatctggaagtgtaaacgtgcttgtcaactgagtgaatatattattgagtctacagtagatgcgtattatgctgtggaaatgttgtataatcagacagaccagatatatgatgaagagaatcttcctataccaaattctttacgctgtgagctgttacttgtattgaaaactcattggccctttgatctagaattctgggattggaaaatcttgaaacgacaatgtcttgcattaatgggagaagtagcatacattgtgtcttcaataggatgaactaaatgacagtgaggatatgaaaaagtggtagactaccaagaagagagtaaagaaacttctatgaatgggctttctggtggagtggtgctaattttggccttcttaaggacttggtgatgaaaagacaaaaaaagagaaagataaaacaagtaaaaaaaaaagggattaatatgtgcttggattatgtat

SEQ ID NO: 8262 - DNA, 324 bp, Homo sapiens
ggtgaccatgtgagatgtggattaccatgagcaaaacacgacgaatgaggacacctctgaaatatatacaaagcaacatactgatgattgtgataacgtgccgtaaatgtaactgatctctctgtcaccaatgacgacagaggaggcatataacacaaatggcaaataagggtctaggactggaggatccagatgagactgaatgaatgctataaataatcggtggctaccacgcatatgaatagagaatcttcgtgcgattagctggttaacaatattggataaccttcatacgcataggaaggatatgtagtaaattatatt

SEQ ID NO: 8263 - DNA, 194 bp, Homo sapiens
aagcttggtatttagttttttttttttttttgtgggtttagagtggctcaggggggcgttaaggtgtgccagactgtacgcgcatagttcagaaaaaaggggcttgaatttcatgtgcaacttgggatggggggaaagggggacgtttgagaaggagggaaaacagggggggaatatttttcaaatcaaccttc

SEQ ID NO: 8264 - DNA, 194 bp, Homo sapiens
attggggcaatctcaaaagtagtaaaattttttttgtcttttggcttaactctacagtcacagcagaccaagtttcagcttacatttaataggcagaaggggagaaaaaaaattgacaggaatgaaagtgcgtaagaacatcacccttagaaatcaattacaaggtacttacatggaagtagaaaaccatctct

SEQ ID NO: 8265 - DNA, 226 bp, Homo sapiens
ataggccgggcctggaggcgcatgcctgtggtgccacctgcttaggatgctgaggccagataaatgattgagcctgtgaggcggaggatggggatacattgttgattagctagatgagcttgaaaatatagagataaacaagatcctagagtgcatgaagttggcatgagaaatggaatttgtttggtggatgaatctgaaacataatgttagtgacagtaaaaag

SEQ ID NO: 8266 - DNA, 162 bp, Homo sapiens
aatctatgactgcatacagttactaatacaaatattaattacaccacactttggaagtataaaaatggtaaggtaatggtgtgtaattgagaggatgagatgagaggatagtttaggccgtgtcttgctgcttacatgaaagaagacttgtaacaatgaatt

SEQ ID NO: 8267 - DNA, 418 bp, Homo sapiens
tgatcagaacacatcagattagctacagtgttgggattatgggtgtgatctattgctgacggattgtgatattgtttgtgtcattatttggtcactttgatatcgtagattattattgtgttgtgttaatatagtataatatgtgtattcaatcacaaattaaaagacaatatagttgttatcatcaacagggaatgatgaggaaggagtgtaaggagagatcagagactgcaagagaataagtgcagagaagccagcagagataattatatatgtattatataagtatcagtgtatgtcgtggttttcatattgctaggtagattcataaaattgagatctctgtgatactatagggtatatatgttcaacttgatatgaaactgtgatgtgttttccacagcggatgatacggccc

SEQ ID NO: 8268 - DNA, 434 bp, Homo sapiens
cgggtatattcatagttaagtgataggtacaattaaaaattcatggcatgtgattaaatatctatcgacacatgctctgtttattatgtaattctgatatcttgaactaggatgtggatgtggattgtggtctgataggtatctattggatactactaccaggttgagttgttcatgattgacatggaaaactaccaattgttataacatataataatcatctatacttacatatgggatggttcattagggtcgacaggtgtgtgcagtgtcccatgttagtaatctgacttaatgtgaaatttatgacccccccttggtgctcctatgtggttagtggatctattatattttctttctgtttggcttttctcttttttctgtgttataaccgttgtgcggtctggagaatagtgactattttgtgtctgttt

SEQ ID NO: 8269 - DNA, 306 bp, Homo sapiens
ggtctaattctctcttttggaatgtagattttttttttaccatgctttacgatgtaaaatatttatgttttattgattcctggatatctggctgagggattatacatggaacaggaagatgcgtggtgactattcttgtcggtgatgttgagagtctctcgtgactgtcatattgtagtggtagatcatatattcactctggtaggccgtgacttttaggcttagttcagactgtgtgggcggcgctctagatgacttgtgtctgcgcgtctgtctggaggacagcactatgggatagatcctaat

SEQ ID NO: 8270 - DNA, 290 bp, Homo sapiens
tgtatattctagaagctgataattccagttctggcgaactaggaagattagagcaagattctcaatcagcgtatgatcttcggagaggtgtgggaatgtgttatataacattcatctttcggtgtgctcttggactaatcaacttatcttccataagatgtggttatgggttctgtattagtggtggaggtgggatgagacgcacttaatcatgatgaggattaatttagatattgggtgtgatagtgtcttgagaattgttaagcactattatgtaatagctatttgat

SEQ ID NO: 8271 - DNA, 178 bp, Homo sapiens
gaggctgtcaatggtgttagagaaatgagggctccctaaaacaatttctttatgtatatgttagtcaaaagttatcatgctgtgactatagttatagcgatgaagatgaagaaaaggcagatgctttgatcagtttactcatacaggaagggatagacataagtgacctcttcatgcc

SEQ ID NO: 8272 - DNA, 194 bp, Homo sapiens
cggagggataagaaggtaagtaagataatgtaaaataaaaataagtgatcaaaaaacatgtaaaaaaacaaatatatttagagaacataagttatgttcttgttgtggtggtggaggtggggagttggtgaggtggtttcatcgtcaaacgaaacagcacgaaataataaagaagaaaatacaccaaaaaacaa

SEQ ID NO: 8273 - DNA, 258 bp, Homo sapiens
ttgatcgagaagatgagaatgtggcttgtgatttacaaagaatattaggcttatagtctcagtaacataatgatcatttgaaaggtatatgaatgtgttggataacagtttacatttgagtgtgcttctctataacatgattgatctaccctaatattatgattatgtatataaggattgggacatgtggatcaggtgtccggtattgatggtgacgatgatatgtgattatgggtgtgagagtgaatattgaaatgg

SEQ ID NO: 8274 - DNA, 498 bp, Homo sapiens
aggtactaggaaaaggcctggctgccatccatcgctgcctctgagggtggagaaggaggcgggtgatgtgctcacttctgatcaacatgtgttgcctcctctcagccaacttctagctcactgcactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagtgttatgtcatggaaaagacaccaaacacagcaagtattttaatgaatacaccatcccaggggggtcagtaagctctgcctggcaagaagacacagtgagaggggtccacagttcctgatgagggtgggtgtgggtacttgtagaccctaacatgggcaggtctgggtcacctttagaaactctcagagaaact

SEQ ID NO: 8275 - DNA, 258 bp, Homo sapiens
ggtacatataatacagtctgtcaagagaactactggttaaccaggaaaacttggcatgattctcagcgatattgtgttctactgaaaggtacaggaatgcatcagataaaatataaagtgtgatgtgctcttgcgacagcgtcacgcatgtgccctaagatttagttgcttggatccgaaaagagggcggtgtggcattaggctcctgtaggcagtatgaggatgatatcaaatcatgggtgtgaaccttggctgctg

SEQ ID NO: 8276 - DNA, 242 bp, Homo sapiens
gccgccccgcggccagggtacaatgacacctttggggaaggaaaagaaagactaccgttctcaccccctgaccatttggtattagcctggctgccctcaaaaacttcccacgctcccctcccctgcgccaccctcctaaagatgacctggatactacggtgcctgcccccaccccagttagcctccccctactccctgggcctacggagcgcgcacagggcgcatgtacctcctaagaaatt

SEQ ID NO: 8277 - DNA, 162 bp, Homo sapiens
  misc_feature (1)...(162): n = A,T,C or G
tatattaatatntgaatgtcgttgtgattcttatggtactgtgatatatgctatagaaagatggattggagggtttgaataggttatggtatagtcaggagagatagaaatggtgtatgggaaatggtcgtggtatgatatgatatgttattctgatcttca

SEQ ID NO: 8278 - DNA, 402 bp, Homo sapiens
  misc_feature (1)...(402): n = A,T,C or G
atcatgaaatatactctatccctcttctgcttaatatagatctgatctcatactgacttagaatacaatgatatatgtagtgtgtgagtcgtgcagtggcaaggtcaggaatgatagtgatataggatatagtcttgtcgtggtgacgggatattgagtttctattatctaacttagtgtcacaatcttgaagaagtgaatagtttgaatcagaccagttatcattcttgatggaggaaaagggatgatganggtgggtgaacagcatctcctttgctgcctctctgcctccactatcctgtccccatgaggagcggaagaaccgttatgactgatgagtggttcactgcatccctttctcctggcgtggtcttggctctagctgcactctttaggggcaga

SEQ ID NO: 8279 - DNA, 274 bp, Homo sapiens
tgtattgaagtaccaaatctattgatgtttggtgctgataaagaatgtagactgtagagactagcagtaattacttgttctacttaatgatgtcctatgttttattctacatgcaaaaagaatgattgatcttcgagcattgttaaatgttgtgggcggtaattattgtggacagatgattcttgattttgagtctatacagatgtgcattattgctgtggaaaggcacgaggcagctgtgtagctcttataaataaggatcaaatattagctt

SEQ ID NO: 8280 - DNA, 194 bp, Homo sapiens
gtgatgaagttaaaattattgagtgggtgcagaataagagtgtatacagtagagaatagaagtaataatatggtctacttaatgatgtcctatgtaatattcgacaggcaaaaagaatgattgatcaccgagggatgataaatgttgtgggcggtaattatagtggacatatgattcttgaattagagttatgg

SEQ ID NO: 8281 - DNA, 178 bp, Homo sapiens
tttggatgtaggacaactcatttgagaatggtatgatgaatggattgaatctactgggtgataaatatgcatacaagtgaccagctacttggcgtcaattcaaaatactattgataatataacaaatcccaagatggcatggtacagaaaagtggatgatgtgcatacttaatgttca

SEQ ID NO: 8282 - DNA, 162 bp, Homo sapiens
cacagcagagggcaagcggacacgacgaagagacaaaagacacaaaacaagaaacacgaaaccaaaaacaacggccaaacgcaacacaacacaccaacacaacaacacacacacacacaaaaacaacacaacgcaacaaacaaacaaacacaggacacaggc

SEQ ID NO: 8283 - DNA, 242 bp, Homo sapiens
gcaacacgagccccatacacacagcaccggggcaaagcgcagagccggacgggcaccgggcgaccccgcgccccgccgcagcaaaaacaaccaaacacgggcaaaaggagaccctaacaagccgagaagcaaaacgtcatcacacgccaccccctgcgcaaacccgccgggaggagcacaacaagaagcacccagacgccccagccaaccccccagagccccgtaacaaacgcccagagagg

SEQ ID NO: 8284 - DNA, 530 bp, Homo sapiens
  misc_feature (1)...(530): n = A,T,C or G
gggcaggtacaagtgtgcagagctgggccttcattccacaggacataatgcatggacaatataatgttctacagaaagatcatgccaagaccagtgatccangaagatcatggaaaataatgcacatcagtgnaacaagagaacccatagagcttaaatgtgtgtctgtgacaggattcactgcactgtttacttgggaagtggaaaggatgggctataccattaccctctgggatttggagacccagggcatgcagtgttcttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattgccatacatgcactataggccgggatagaaaatcgtcagctggacacaggaaatttctttttggagagcaag

SEQ ID NO: 8285 - DNA, 306 bp, Homo sapiens
acaccaaaaagtaaacatgcaaagagggccgaacaacagtcataatgataaggtctgagaacaaaatcaggagaggatagtgctaaatggctgacaggatattagccatacgacattaactacatctggtgaggaggctacatgactggagaggcagcaaacaactggaagccaaagaacacctcaatgcatgactcagaggggatagcagcagaatatactgcaccctcggatccgaactaacatcaaggatataggcctaaagaggatggagcttctaagatgttatgaactggtacgagagca

SEQ ID NO: 8286 - DNA, 194 bp, Homo sapiens
tgagaaggcgccgggcccgggactaggcgtgagccggggagggtacactggggcgcagctctgcggcactcgtctggtggtaataaataaactaaaccatgggtcacaaggtacgatccctaatgaagctccgagtaggacaaaaatgctcgatgatgatgtcacttccttctgttgccagaactttgcgtcgt

SEQ ID NO: 8287 - DNA, 178 bp, Homo sapiens
cagttgcagtagtataaatccgaccgtgcctggcccagcaggacccccaggtggacctgttgaccaaaacaccagcatctggggccgtgtagtacaggtaccctgtctgaacgatagttccaaaaaactgcaagtaagtatggtgggatatagaccccaccccactaacacagtgttt

SEQ ID NO: 8288 - DNA, 194 bp, Homo sapiens
tgtggtggctgtataggcaagttctagcagccttcttttccgacaggtccctttccaataccaaccgctggttgctcacctgcattaaccacccccacgtgcggtctgtcttgggggaagtggaaatgggtggagatgatggcctgagtgttggatggtgagaaaaggtttgtcgaggaggacgcgtaggcgta

SEQ ID NO: 8289 - DNA, 210 bp, Homo sapiens
agcttttgttttttttttttttttttttgggaagggatgatgtgattttttcttttataacatgatttttaaagacattatgcatgggggtaacattcccttgaaagggggcttgcaagggttatgagcctctagccgagctggaatctggaggaagaggcagagaagcttggggaaaaagaggcaggggaggagggggggggcataagg

SEQ ID NO: 8290 - DNA, 162 bp, Homo sapiens
tgggtgataagggtagatgtattattattgtttttgattttgatgttgtgttttttaatgatttgattatagggaaatattatgtaaaataagtgtggataacaagtattgaatagggaaggggatggggattgtgggggagagagtgagttgatagtgagt

SEQ ID NO: 8291 - DNA, 162 bp, Homo sapiens
gttgtgagggttgggtggtgttatttgtaaaaggggtgaaggtgaatttagaatggacttatttgttgttgtgtttaggaggttaaaataatataaatgaaagagtggaagaatagtaaaagtaagggggaaggagggataagggattgtggtttggtttgt

SEQ ID NO: 8292 - DNA, 514 bp, Homo sapiens
accgtttttttttttctagagtcagtaaatataagcttgagttgaaagactttacttattcctgctgctacaatttaattctctaataataatattatattcagagtatggcttattaagtacagggcccacatattgaaccaagttcatgcagatttggattgaagttaatactaacccaattacaggttgactataacttgactcttaaatttgatattatcttcaaaattataaatagattacagagatttagaactggttataatttagtaagattaactttgcagtgttagaatttttagcaacaaatttttagaatttttttagcaaaaagaggaaatacacattaacaataaaatatgctagactggctctgttggctgaacagagcatcatgtggttaaagaactgtagaaacgggcttaccaagggttgaattctacccactgctctccggtgatgtagctgtgttatcctctctgctgtattctcgggttctcttagggtcatt

SEQ ID NO: 8293 - DNA, 210 bp, Homo sapiens
gggagcgcagggagctgacgtctttccgttacaaccctgagttctactctggcattggggactgtgaggtacacatactcaggtccagggatggaggggtggtcagggacgctataggtgaccttctggttgtatatacgggtgtgtgcttaacagccaaagtttacctgagtccgttttcttggggtgatgaacagatgctgtcttgcc

SEQ ID NO: 8294 - DNA, 242 bp, Homo sapiens
tctggagtcggcaggatagcgggaacagccactgggctttggggaaaggactcgattagtagatcgagagtattcgtttctatgcattatcaccagcgcggcatgcatatgttctaggggcagatcattttatatatctgagttatttaggttgattcattgcaggggtctagttacatggaatgagggtagacatgagttctgtaattacatgagagtaggtaatggggctttcttcagag

SEQ ID NO: 8295 - DNA, 258 bp, Homo sapiens
gagtgagcatacattaggatagggatggatgctagtctaagtattgtcgatgtgcttactactacctcctgtgatcgtaaaggtgattgatatataggagtggtcttgctatgtacgtgtatgagacagagtggatggtgaggttaagaagatggacctgttgcgcgccgttttgcacatggtatagatagatggtgatgagtgcagaataatctgatgcttatgtgaatgagtacgagctggatttgtacagccggt

SEQ ID NO: 8296 - DNA, 354 bp, Homo sapiens
ggcgcaaggcagcactggtggtgccggcattcgagaccctgcgctaccgtttcagcttcccacaattgaaggtggagctgttggcgttgctggatgctggcactctctacaccttcaggtaccacgagtggtcccgaggcctcgcatcttacagactatgcccgctggcgggaggctcaggtcccgtaccgtgtgcaatgggcggcccgctatgaactctacgtggtggtgccacgagactgtccccgctatgatcctcgctttgtgggcttcggctggaacaaagtggcccacattgtggagctggatgcccaaagaatatgagctcgtggtgctgcccgagggcctccgcat

SEQ ID NO: 8297 - DNA, 162 bp, Homo sapiens
  misc_feature (1)...(162): n = A,T,C or G
aaaanaagtaccacctgagtcagtgagggccacagattggtattaatgagatacgaaggttgttggtgggtgggtgtgtgctggagctaagtggataagaatgtagtgggagtggaggtaagaatgggtgggggtaaaggaagggggatgggagggcggggg

SEQ ID NO: 8298 - DNA, 354 bp, Homo sapiens
tcaaatgtagagtagagagggaagggaaggagaaggtgggaagtgaaaaaagaagatgaaaggaggatatagagcagaaaaaagaaaagatgagtatttgtgaaaggggaggaaaaaaagaaaaaaagattgaaaaggaagaggatttattgtatagaagtaattgaatgaggaaaatggtgtgtttgtttgatttagatttgtatattttagtaaattatagttggggttagagaatttgtatgatataggatgaacaaaaaagggttagagagagttatatgtcataattctgaatttaattgtggtgtggagatgttaattaattatataaaggagaaaataagttgttaa

SEQ ID NO: 8299 - DNA, 194 bp, Homo sapiens
tcagtgtatgacccgtgaggtgcctgagcgtatttgacgcgtttctgatgattctgcgggaacagtggtgcatgtgccgctagaccggcgagctcggcgacttgagtgatgacgacttggacgtggtgtccaacgacaaagagaagtgtaagacgttagccggacacgtctgagccaggagggaggtggggttg

SEQ ID NO: 8300 - DNA, 226 bp, Homo sapiens
tctggttactatgtgacctcagggagaagttagtaagatattgtgcatacacgttattagatgggcgtacaagtgcatacaagtgataaaagaagggtgagaagagatgtctgaatccagaatcgaaggcgatcaagaattactgaaagcagttgagcgaggagaggtaggtttgatgtagccggcagaagaatcgctatttaggaaacggcaaactgggagtcgg

SEQ ID NO: 8301 - DNA, 533 bp, Homo sapiens
  misc_feature (1)...(533): n = A,T,C or G
tacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaangagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggcttcgacaaggcaggcgtgagc

SEQ ID NO: 8302 - DNA, 594 bp, Homo sapiens
tcaggtgggcgtcccctcttcccttgcccttctctgcacggtaactccgtccctcggcatttctcaataccccttgcccctagatccaagcctgtctcttgaggaacaaccgcgcagaccctgcctcttctgaccacacgacccgccttcagccacttggtctggtctcagacccctcagagcaggaagtgaatgaattgtgtcagtcggtgcaggagcatgtggagctgctgggctgtggggctgggccccagggtgaagccgctgtgcgccaggccgaggatgccatccaaaatgccaacttctctctcagcattctccccattctatatgaagctggaagctccccaagccatcactggcagcttgggcagaagctggaggggcttctgagacaggtgggcgaggtctggcgccaggacatccaggacttcactcagggcaaactggacacagcaaggagcctctggccacagatgctgcagggattcaggtggagggaggagatagagggggtctggcagggtgggaggggctcccggagctggtcccagagcaggggtgggagatgccttgtgttagctcagggagatg

SEQ ID NO: 8303 - DNA, 178 bp, Homo sapiens
aggaggaaggtggtcggtgtgtagcaagatagtagagagaactatgtcctgatcctctgataggaaatgtgaagacgggatgttttgatgggtcccagggagctactgcttggtacaggccccaggaggagggccaaactctggacctcatttctgcagtgactaatctggatgtacg

SEQ ID NO: 8304 - DNA, 178 bp, Homo sapiens
gggtgacatgtcagatctttgtacgtaattaaaaatattgtggcaggaaaaaaaaaaaaaaaaaaaaaaaaaaaaaaaaaaaaaaaaaaaaaaaaaaaaaagaaaaagaaaaataagtaagggggccggagggttattccctttagggagggtgaatgtttagtttggaggtgggcgg

SEQ ID NO: 8305 - DNA, 642 bp, Homo sapiens
agtttcttctaaggcatcaagagccccaggctgaaaagcaccccagagctggagcttatagaacccagggcagcaggttctccaaccttctgacatcatcagagcacagcagacaagttatcagccactagatttttttccccctttctgaaactgtaacctttcattccagccattccccagagctggacagaggacgtggctggctggctggtttctgtagtcagaatgacagttgggtgatagatctccttcgtgaagcaatgtcttagctcagtaactctgcagagaagctggctggttcaggatgtggcttatgtaagaagatggccctggcgttttacgcgcactggtgggtgaggctctgaaagtggtagaagggaattctttcctagagttcagctgcccgctgtcctgctcctcaggggaaatgctgtgagatctgcatttagcctgtgtgtgctgattgtggttctgccgcttcctggctgtgtgagctcagacaagtcacccaccccctctggggcagtttcctcatctggagaaggggagagtgccccacacattgggctggttgtgtccatggagtggctgacaataaccagcacacacgagacatcagtagcaggtgggttcttcccc

SEQ ID NO: 8306 - DNA, 546 bp, Homo sapiens
cgttcttctaaggcatcaagagccccgaggctgaaaagcacgccagaggtggagcttatagaaccgagggcagcaggttctccaaccttctgacatcatcagagcacagcagacaagttatcagccactagatttttttccccctttctgaaactgtaacctttcattccagccattccccagagctggacagaggacgtggctggctggctggtttctgtagtcagaatgacagttgggtgatagatccccttcgtgaagcaatgtcttagctcagtaactctgcagagaagctgcgtggttcaggatgtggcttaagtaagaagatgggcctggcgttttacgcgcactggtgggtgaggctctgaaagtggtagaagggaattcttttctatagttcagctggccgctgtcctgcgcctcagggcaaatgctgtgagatctgttttttagctgtctgtgctgattgtggtgctgccccttcctggctgtgtgtactccgacaagtcaccccacccctctggggcgggtttcctcatctggaag

SEQ ID NO: 8307 - DNA, 370 bp, Homo sapiens
atgctcgattgtgtaccatgtactggagaaaaagcatcaagttcttaaaccatgtagcttcgtaccttagtacgcatcctctatctgtggaggctcaaccaattattagccagcagacagtatatgcattgaaaatggcctaatgtcatataactgatgggggtggaaacaggatggccgaggaagctgtgagggtggatagagctggcttatcattctgtgctgtcttcatctgtccataccgcttccaggttgcatcactctcacagcgtgtgagtgacagtatcaggatggttgccggagtctcatgcgttgtgtttatgtataaagggtgcagagagattcactgaaacagatactaaaggataac

SEQ ID NO: 8308 - DNA, 450 bp, Homo sapiens
gagtgagactccggtggcaggaacaaaaacaaagaaaaacgacaccaaaaaatataaaaacacatcagcttgacattttggaggcattcccagactcagggttagtcagcagattagcatttaagaagaaagtcttgtccctacagattgcctgacctcagctacccatgaagggtgggaagaggagtgctgaggaagaagtacaggaaggggacaacctcctcagacctgataggacactcctgtctccaccctgcctcctgactgatttactctcgggggtgtgaggacctctgagataggcgccaggagtctcacgcgcggcactgatgtctcaagggtgacccgagagtcgctgaaacagatactagaggaggggcaggtgataggataaagtgagaggtactgagacttgctggcgtgggtgagcggctccgggggggccgaacg

SEQ ID NO: 8309 - DNA, 642 bp, Homo sapiens
gccgccactggtcgaactccattgtcggggggcctctaccagccgcccctggcgaagtccattgtcggggggcctctaccagccggccgtggcgaactccattgtcggggggcctctaccagccgccgctggcgaactccattgtcggggggcctctaccagccgcccctggcgaactccattgtcggggggcctctaccagccgcccctggcgaactccattgtcggggggcctctacgagccgcccctggcgaactccattagtggggggcctctacgagccgccccggtgaactccattgtcggggggcctctataaggcggcccggtgaactccattgtcggagggcctctataatgcacccctggcaaactccagggctcgactcaggtcggatcgagcccgctctggggtttcactgaaatcgtcagcattttcagagacagcaggagccctggatgaaaggaagactggcacccttgtgtgggaaggaccctcccccgattttggaacagaggaggcagagctcctcctgaaaggtggcacctgccccggggctctcctggttaccccggagcaggatgaggccaggaggtgagcgatgaggccaaggttgttaggaaaggaggggcagctgggt

SEQ ID NO: 8310 - DNA, 370 bp, Homo sapiens
gaggcccgacctgggaaggctggcgaacgctaaccggagggtttttcttccagacttgattccgggatgttgagatcgttattcgaaatagactagcattcgagtcgcctgtgatggagggagttcctgcaccgtaggcctggcctcatttattctgcaaatgtttattgggtccttgccctttacaagatcctgtgctgtgagcaggatcagggctttcatgtggaaataagtcggcctttggttgaccaactgaaactcctctgaatggaaaatcaagaaatttttggaaaacttagtaaaatgttcaatgagttgcatataagtattccttgtttaggtagcctggactttgtgaacttgagattct

SEQ ID NO: 8311 - DNA, 434 bp, Homo sapiens
ccagagcgagactccggtcttaaaaacaacagcaacaacaaaaaagatttgatgcctctgatggagctgaacatttattatacagcaacagcagcaaggattgctggtgggcagactacactgtagggcatctggtcttctgttagagtctgaaggacactattgtcagagctctgcccttttggaatgaagaaataattcccagatccaggaggggaaacaggtgttggttgagggtcctggcagcagcttttctggcacagtcgagacttgggaggctctcccggaagggggcatcatggagctgagcctgcccactgggtattccattgtctatgaattgaacaggaggagcttgaagcccattgagctcatgcaggtaccaggagacgaagagggtgtgcataaagacatggaaggggtggtggttaggg

SEQ ID NO: 8312 - DNA, 482 bp, Homo sapiens
cacgtttcacagatgtggcaactgaggctcagtgaggtgacctgccaacatcctcaggctcagcagttctcaagcactactgcccactgtacctgattgcctgggtctgcgcctgggcccccgcccttttacaaaagggtcacggcctctcaagagctggacatgaaggatggggcaagtccagtcttgatcggtaatgcccacttgacactcccaggagcagcatcatagcatttatacaactccttgtctcattcccgatgctgggcacacaggccatatcagtggactcccctcacccgtccattcagttacaccacttaagcctgcccatgaagacaatggctaaggtgacagttggttacataaattgaagatgagtctctcctccagatgcatggtccgtgaagaaatttaatagcaaagacgagaagaagatacaagtctttaatagttctctgggtattttctcacccaaacag

SEQ ID NO: 8313 - DNA, 466 bp, Homo sapiens
gacatgccccaggggacatcagaggtctctctgcatggggattaacaggagaggaggaagccctgacatgtccaataaactcaatcatctggaagatagctcagtaggtgtatccttgacccagcattgtgggagaagatatgtctggaatgtgtatatctgcggggagtgagaaaggaatgtcagcagtcaggatgtctgcagatggggaattagaaatctgtcttagtgttggtgggagccagttcaaaagagacttcagaaggattgatggtttagacggggtatctatataggacctgtttagattaacttcagtggaatgagggatgatgtattaggataatatagttagctgtaaccagcaactgagctgtaacaaagccactgacacttctcactcatattctatagtccagtgagggtctaggggacagggggtgctctgctccctccattctttctg

SEQ ID NO: 8314 - DNA, 322 bp, Homo sapiens
acagtccggtaccagatcgccccatctgccatcaagaatcaataccacacactccatccacaccactcccagccctgagaggggctctggccagctctgctaggtctgagctgtgtctatgcccggatgtggcagataaggagaaccatggtaggagccgtaagcagctgtgcgcaggcagccagagggtctcgagggaggaaggcgagcgggcgggcggagcctggcggcgggccacagcttcaagagcccaagccagcggtgcggctatccgggggatccatatagagagggaggtgcggcgcacggccatctagagggg

SEQ ID NO: 8315 - DNA, 562 bp, Homo sapiens
gctgcagccaagattctgggggctggggtggcgggtggaggtggggttggagggagcgggaggaagcagccagaactaccaggcggcattgcccagcttcttctgcttggccgcctcccccgccagccggccggctatttttggcatcttggcagctgagcccccctcggcatccccccaggccccgtggcccaaaccaggttgtgcgtctcctcacggttcccactggccttcgatcctcatttgctaaatatctgcgaaggcagctcccgcctccccagtgcctacgcgaatttaatcccagagcgaacagacgcggagccccgggagactgcttcatgtcagagatgaattgtacgtaagtgaggacagggtttgtatcttgcagctgtaattcattaagatgaggtcacgcaggagcagggagaagcctaattcaatgactggcatccttataagaaggaaatctggacacagagacacagggcacgggcaagtcacaacacaagcagagactggagtgattcatccacaagtcaagtgacaccagggatgggcagct

SEQ ID NO: 8316 - DNA, 418 bp, Homo sapiens
  misc_feature (1)...(418): n = A,T,C or G
tgctgatctgactgtctttttagtggtcacactatccttaccttctgtgcttaccattctcttgtttactaatatgatatagtacatttctcatgtctctctaagaaagattgttaatgtatggctggttctgcttcatcttaaagtatttatactgtatgtggtcttctgctaatctactgatatctgtggtatgattattagaatcatatatatttgtgcttgtggttgaatgtagtattctatcatttggtcatagtctcataattgctacattgagctctgcatggacatttggatgctttcttattttatgctagtagtatgtgtgtgaggacagattagtgatcgagaatcactggaatgtggtggtgagatatatatatnttctccatatctaagtaagggattatatttc

SEQ ID NO: 8317 - DNA, 242 bp, Homo sapiens
accttctgtgtaagagtcagtgagagtagtagattgagatgtgagaaatagtagagaattagatataatggagaagttggggtggggtgctctttgaggactagctgctgttcgtgtgccttgtgatgccttcagggtgctgcttttgtctgctgtcgggtggatgtttagggtgaccagtggctggatcatgtgcggtgcatgtatacttgtatttgatcgcaggtagttatagaattatt

SEQ ID NO: 8318 - DNA, 258 bp, Homo sapiens
ggcgaatgcgagtgaacctcgactggtcttcgattctactaggttgtcactatgaccaataaccacccataagaacctcattgtttactatttggattgctgtgtatatacaagacagatatctccctttatggaaggagtaatatgatgaatcggtatgggatgggttgcggtgtcttggtcgtgatcaagctagttactattgaattgggggccgcgtgcatgtcgatcatatgggcagaaagtcctagcgtggtt

SEQ ID NO: 8319 - DNA, 546 bp, Homo sapiens
ggtactgaacagggaaagcatacctcaccacagcgattagcatagtgcttccatgcgtgatgtgacgccatctacttacaaggggtggcatttatatcagtaacaggatcactggtgtcatcatgagtagggtgatatacatcaatacccaggaccaagcatgatcatcctgctaatactgtcatgatgtgggtggggatgttccagacaggaaccagaggacaggagcgcagtaccatgacaagcaagatgaccagatccttcacagacataggggaaattataatgactctgcctttggactataggtataaataatggaatggtgaaggcttatggacatgtgtgtctaaggtgacatgtaagcgaatgatgagaggtgacttgaggcacgggctccaaagaatctcacgatgtaagctgtccggccataagtgcttgagacagaacagataggacgagtaaccaatcggaggggcgcaactcactatacaactattctatccactgtggaacgcatgattgtgtggatggtacagatacggc

SEQ ID NO: 8320 - DNA, 274 bp, Homo sapiens
gtactatctgtgaagttacacttttttttttttttaaaggtagagatgtgtgtgtgtgtaggtattaaagatgtgttgttggttactaaaatggattagtgggagatgagttatgaatgtagatgtattcagaagtagggtgacagattttttggtgacatggcgtggtggggtggaaatacagtggagtctgaaggttcggggagcgaagaatggcaatatcatcgcacatccgtgctccacacagcgctagtgacagatggagacctcatag

SEQ ID NO: 8321 - DNA, 290 bp, Homo sapiens
gccgaggtacatgcctgtatacggacatcctcttatttaagtgtttgtctctttcgtcattggggactccagcacccaaacatagttccctagtatactagttggtgccgaataaaaagtagctattattagaaaaggaaggtgaaattgacatgggagttagtaaaatgtataaggaaaatgatttttataggggaaaggtaaaggattttctggccggaaaaagcagcaaaggacaagtattacttaaagtcttgtgaaaataacacttcttcttgcttgtacctggc

SEQ ID NO: 8322 - DNA, 242 bp, Homo sapiens
gcccgggcagggtacaagcttttttttttgtttttttttttttttttttttgggttcaagataaaaacaaagtacaaaaggaaaatggggtgctgctactaatgcatcatacaaaccaatagcactgccgacaccgccaactcaagccattccaaccaaaggaagaaaggctggcgtttgcaccccctgagggaagggctggcttgtaaaacagcacaattcggagtggaatgggaagggta

SEQ ID NO: 8323 - DNA, 226 bp, Homo sapiens
ccgcgtcggggcagggtggcttaacgaaaactggaaatgtctgttgatggggaagaaacaagagctaatacaatagctaggagcaaataatatttctcttatatagcttgaaggtagcaggtacagtagctaggtacatagtgaaagaaggattacgatggtaatgaaataatttgtttgatacgctaatggctataggggatattgtgtaatatttgtaagtttg

SEQ ID NO: 8324 - DNA, 290 bp, Homo sapiens
acaagcttttttttttttttttttttttttttttttttttttttaaagcattaattaattaccacactttagaaagtatgttcgccggtaatatggaacgtagggggcaataaataataaaaggaggcgggaaaaaaaagacagatacggggaacatagggggccccgcggctccaggggcctcgaaaggtctatcgcgggaccccaccccccaagaagaaaaaaaccccaaaagccaggggaaacccccccgggggggggtaaaaaggggggaagggcccggggctccc

SEQ ID NO: 8325 - DNA, 226 bp, Homo sapiens
agtcttatttagcaccccagccatgtagacttctcatgctggcccttcttggcatctgctcttctcactgtcatacattgtgggaaggtgtaggggagtgtaagttctcagtataagtaagaaccctgtgtgagaccctccactacccagcgcactggccggtttaggaggaaatcaagtacactacaccaatcacggaaaggtctccttgcagagccagttaatt

SEQ ID NO: 8326 - DNA, 194 bp, Homo sapiens
cgggccaggtacccttatggaccctggcacaaaaatgattcagcttcagcgccttttgcctgcagttgcaggctttatgaagcaggttctccacctccagtaaattaaagtttttaaacaagtacccagggagaacggggaccctgcaccctggattactgggactggcacagtgggaggaaggggggaccgtg

SEQ ID NO: 8327 - DNA, 306 bp, Homo sapiens
ataagctagactccaatattccacacagctgactgatacgtggatgcaataacatgtgcatttcttaatactacaacttcatggacagagtagggtggtgagatgaatttgactgtgtctaaatcagtgtcctaaatggctggttctgtctgtgctcctttgacagagagcaagacagacggtaagtaggagattgactataatggggagatgatcgactgtgtgtgagagggggaaggggtagagagaggagggaatattggtctcagaggtctcaccatcttaatttggttgctcctaatgata

SEQ ID NO: 8328 - DNA, 530 bp, Homo sapiens
tacatgaagtctgtcttttgtcaaagttctatgcagtcccaggatagcgtgatagcagtggttaaacacaaccagctagttatagctttcattgtatggaaagacctctctggtctggaactctgcctttgaaattatccacgtagttcagaaggcaaatacttgttaaagggatcccaaaaggtaggagacaagtagtttttgttatgcattagggcagactttcaagcacaagacacaaaattgagcagcaaatgtttgggtagtcccatctcccttcggtttatatgtgggtagtaaaataaataaaaattttcttctttgtctctttcttgaaataaaatatcatgtatccaaagagagctgaggattctcaatttgctagattgctttaaaggggtcagatttataaaaataaagaattaatgaagaacaattttactggagttagtgtggtcaataggcccttttcattttgtgtcattgcttttatcacaaagatgttcaaatatcaaataaaatgttctctc

SEQ ID NO: 8329 - DNA, 162 bp, Homo sapiens
tttgtggaaggtgaattattgcaattttatcttacaacacaatagggaatagtgaattgatatataaatattatttatgaataaaatactaagactacgctagttagatgttgcaataaatcgaaaagggatatatggtgcataaaaagcaatgcgctatgc

SEQ ID NO: 8330 - DNA, 450 bp, Homo sapiens
gtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggtccctttgctgctaagtggttattaagggatcctccaccacccccccctgcaccaaaagaggaggaagaagaacctttgcctactaaaaagtggccaactgtggatgcttcctattatggtggtcgaggggttggaggaattaaaagaatggagggttcgtggggtgataaaggatctaatgaggaaggtgcgagggtagagaaaggcaaaaatggtgtggtgaagattcctgaagaaaa

SEQ ID NO: 8331 - DNA, 229 bp, Homo sapiens
ttattcagtgtatttttaggtggtattattatgtttattatttttctcattgatttagtgactatatcttcatcatgttttcatttttatttgttccgaagctcccggaaaatctaacttgctaacaattatttaaagggaggagagaggaaagcaggagcagctgcaggaacagcagcatttttgggtacctgcccggggcgggcgctcgacaatcactagtgaattc

SEQ ID NO: 8332 - DNA, 370 bp, Homo sapiens
ggtcttttggtgggagttgagcgcatcaatttggggtggtgtatgatccatgtttatacacattcatgcttccataatgcggttgctatagggatacgagtgactttcgtgagtgccaatttgacatcatgtctgggcacaagatctttatgtgttctaaattgagaggagatgatctatgacatccttcacttttatcgggtaatactacatgtatagttcagtaatgcgggagggtctctatagacattttgaatttcctagcataatgtctcaggaccgtggtgaagcattatatggtttttccaatacatggttgggacgcaaggcggcgtgtcacgtacggccacaggcagttcattgcccgggc

SEQ ID NO: 8333 - DNA, 530 bp, Homo sapiens
ttcatgatgggttactcttttatgtctgaattcatgtttatatatgcgtatagtcatctatcgtatatctataattatttataatatgtgttatctgcagtgataaattatgatcttgatgtcggtggtgatgattaattgtgtgactcgtcattactatgaagatgatcttgaggctggtatcgtctgtgcatgaaggtgattgagtgctggtgcacaggattttaaagatggctctaaagtgtgcatagaggttggtgttcagacaaaatatgaagatgagctaggtgatcggatgatggaaatacacttgtggagcgtgattctaagactgaagactcgcttgatgatatcctctaagatgaacgagtcgatgctgatctccgcgttctcaggggatcactgagcgatgaaagacaggatgaggtatgagtgtggtctcgacggccggtcggtgctggtggccgttgggatgtgacagcctggagatgatatgtgcataacgagatccagatgacaattccaggctg

SEQ ID NO: 8334 - DNA, 306 bp, Homo sapiens
gatgtggtggtggtctctattgagcatgtgcatgcactcgtgtagtactggaggacacagtagctctacagcgtcatgtggcagaggataatgatctggctagttgtgttttatagaagcagctatctaacagctctcgactcgcgaagacgctctgtcgggattggctgtaagcactacggatgtcacatggtgtagtggctggtctgcaatgagtggtgctgatggctccctgtggttacgagtctgtattcctattcaccgaagggtgtgctggagtgtctgtctgctgtctattaatacacc

SEQ ID NO: 8335 - DNA, 178 bp, Homo sapiens
atacaaaacgcgcaatatctaattatgaacagcgttaaatccctatcaaagttcaaatgaaatgtgtggcttatagtgtgaatgcacagatatatagccatatcatgtcatgttgtgtgcggagttggggtgggaacacgcagaaccggagccacgtcagctacacctcaaaaagtgc

SEQ ID NO: 8336 - DNA, 162 bp, Homo sapiens
agagggaagagggttaaagaaagatgataagaggatcaataaattaattttatgaaataaaattaggtcataggggtatggaggaaataaagaattagatgattatggtaataatgtgtaaaaatgtgattaagtgtaaagggaggtatgatgagaggatgg

SEQ ID NO: 8337 - DNA, 338 bp, Homo sapiens
tgataagatgtgaatacatatagtatcatactatataaataattcttggggtgtactatgtgcacaacattaataagtatatgggaacatgttcggcttatgctgcgttgcgatatattgtgatacagagggatctacgtctaggtatgctgatggaactagtacgagtgatgctcatatgaggtctgcctagcgtccataggcagctccacatgtacattcactgaaatgttgttgtgatatctgcactgaggaagcgcgtaggttatatgactttgtcatatttggtcgtgtataggcataatggaattcattcagtttagtgcaggaaagcacac

SEQ ID NO: 8338 - DNA, 610 bp, Homo sapiens
ctactttgtatcatctcttctattattttgaaagactgtttaatttttcatgtcttacattcccaactaaagacctaaaattgttttgtatccccactcaaaatgccttacagaaaatacaaaaatcaatttgatcgtttccttaattacaggagtcattgcaattagttacataatttgactcttggctatcagagttacattatttgaacttaaataaccatcttcctgtaactgaatataatttatattccctatctccagtaattaactggcataaaatacagaaataccaacaacaagtagtgtaccccactggtaaagtgcatagactctgtggttagacagactatataggattgctgaatcagatactacaatacatagcagtatgaccttaaaccattgtattaagtcatctaatcttctatatcctcattgtcaaaaaattcgtgtatcagctacgtacgaatactagtgtatgaccttccacaatcggcttaagctctctactaatcaatttactcatagtacaaaatggggaagaaaacagtatggtgttcggaacgcacacagtgactgatggagagtatgtgctagggagaaggga

SEQ ID NO: 8339 - DNA, 194 bp, Homo sapiens
  misc_feature (1)...(194): n = A,T,C or G
tgaaagctatataattagacattgtaaatgccttagataatttatgggnattttatctgaagaggtaatatgacatattggattactttgtgagtgtgaatataaagataagagaaggatgagagaaggatggtgatatgagggatgtggatgagaaagaggaagagtgtatgagagaaatgggattagagaaa

SEQ ID NO: 8340 - DNA, 210 bp, Homo sapiens
ctgacatcaccgactcatatgcttattaccaccctgcttgagcaggctggctcccaacggagatgaacgaccgtgttcctgcctggttgttattcgacatgctcaggactgcggggagaaaggatgagatccagcagggaagaactgcctgctgccagcacgcaggagagggtggggctgccggccattatgtccataccaacacaatgt

SEQ ID NO: 8341 - DNA, 338 bp, Homo sapiens
ggtactcatggatccataggaaagcatgtcagtgcctggtggccacactatacatggaattgtggagtatgaggaatatggcacgaccctacctcttcttaagacagttgcagttcacagggagaggaggaagatacatcaataaccccaaagtccatgaaggtgcaaagagttatgtggggctgcccaggcagaggtgacaaatgcccactggtgacaagacactggtggacatagagggaaaagcccacatagaaaggtttccaggcagacaggaagtcaaggcagttggggacgggaagtcaaacaagtgatgctgggacaccgctttgatgggt

SEQ ID NO: 8342 - DNA, 322 bp, Homo sapiens
ttcctgataaaggggactttccatgccgtcaacagggaagtatctgaacatactgccttataccgattgtactcactatataaggaaaatgggtgcagtagtgtggttcactgagtcgggtgggaacaatgatggtgcagataactgccaggagtaactcattctggtgataatagatgggacgtgtgcagcaacacaaaaataagccgatgaaagaaaagtcctcaatagagtgtgctgtagtgtactgggcaccagtaggcctggtgccccctggtacatgttaccttcggcacgcgtaccatcgcttattcagtaagtg

SEQ ID NO: 8343 - DNA, 178 bp, Homo sapiens
tgttccagaagttataagaatgatatactatcgatttttagaagatggatgaaaaagttgtatgctgagtcatacgaatgaatgaggtagacatgggaatgtaagtgtcaccatgttgtgatatgtgtgatcttagggtaaagatgaatgaaatatagtgagtatgctcccattcttt

SEQ ID NO: 8344 - DNA, 160 bp, Homo sapiens
acctagaattaaaaccaagactctgtgatcagaaatcctcaggcccggtcccttgttgcctgtagacaatgaaccaaaagatggcgagttcaacagtgggacacaggctgggcatgatggctcatggctgtatatcccagcactttaggaggccaaggta

SEQ ID NO: 8345 - DNA, 194 bp, Homo sapiens
gaatttagtaaggctttgggcataatgaattagaagcgggaagaggatttgtgcagataagttatgcttcggggctacttctcccatcaagtcaaatctcgtctgaattctggctatctctctagccatgttgcttccgcctctcaacaattcaactgggtggttgaatttagactccgggttctaatcttggt

SEQ ID NO: 8346 - DNA, 226 bp, Homo sapiens
caaaaattgggacgaagaatgatgaaaagtaaatttagaatgtgctgtgccgagaatgaaagaaaaagcagcgtggggtctgcgtatccagactgggggagtggagcaggaaatcacttagcccagagtggcgagaaccctaaaaataaaaataaaataaaataataagaaatggagcagaaggcgttcataggagccaattttattaactaaaccaaacccatga

SEQ ID NO: 8347 - DNA, 546 bp, Homo sapiens
ttcagagcagactaacgtgggctgccattatttctatttatatgtataagagtatgtcttcgtgatctgtataaaaagtgatcgtgtgaaagatgctgattgtcagtatgttatgtcaatgtaatcaaacataattgatctctttaatggtgtaggagatgggattgttctttgttaggtgatgatactgtcagtgacatacaaaatagatgaaagattaatcaatcagacgaaactacgcttatcactaatgaagaaaatgtgaactgggggttgaacataggcgtgagcatcgggtgccttggtggtcataatagaggtatgatgatcgtgtggaggggatagctgatctggtcatggacttctgtgggtaggtgtgaagatgtgttgtgtgctgacatcgaactcaatagaaatgaggatctgattgtgctattgatagagtgtgtgaggcgtgaggatttgctgattctctgcgctgaagagctgtgctgatgtgggctagttaacctgtggagacatgcaggctgcaatgaatgtgggcaa

SEQ ID NO: 8348 - DNA, 354 bp, Homo sapiens
tgagtacttgaaaaaatgaaagtgagagatgtaatactgctggagacaagtggtctacttttacttctaacttgtaatcaatgtgagcgatgatccattatcatccaaatagagtgtggagactatcggaggatacgtgagtgtcaagtattccaatagcaattaaaacaaatgacatgacttcgagacagctgactacttatttcggtaatgtgatttgaatgtgcctggcagtcgcaatatatgagatcgttcacgtgatggctgatgtgtcgccagcatattatatagggtagcgaaaatggagtgagatgctgttgggaggtcgatgagcatgtgattaatggttgtctg

SEQ ID NO: 8349 - DNA, 162 bp, Homo sapiens
ttttttttttttttttttttttttttttggtgttttgtgcttttattttacgaaaaagctaatggcaaaatctacatttaaactatagatgaatccaaagcctttagtgagagaaaggctggtggggtgggattacataaaatggaccagtgggcatatctt

SEQ ID NO: 8350 - DNA, 210 bp, Homo sapiens
  misc_feature (1)...(210): n = A,T,C or G
ttngtgaggtccggagggtacatgctgtagtgcccaaagttgttgtgctttttttattaagtatagccagggattacgtaggttcaaggtcccaccagataatgtccttaatagaaattatgttaaacatttatattcctctacaaaataccttattttcccaaataaagattaataattaggcaggtattaggagaattaaaaaaactc

SEQ ID NO: 8351 - DNA, 162 bp, Homo sapiens
gctatgacagaatcattgtatgtgagcttaaggtctctgcataaaactgaagttaagtagggtagcctgcccgccaccatgagctgacttgaagagctactccctgcgtgtaagtatctgttggcacagtatgtagtggggcgtacgattccagaaacgcac

SEQ ID NO: 8352 - DNA, 854 bp, Homo sapiens
  misc_feature (1)...(854): n = A,T,C or G
ctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacaganaggtgtggcatttggaaacgggaataaacaaaattgctgcaccaatgcactgagtgaangaagagagacagnagatcaaaggctttagacagcactccttcaatatgcaatcacagagaaagatgcgccttatccaagttaatatctctaaggtgagagccttcttagagtcagtttgttgcaaaattcacctactctgttcttttccatccatccccctgagtcagctgggtgaagggagttattttttcaagtggaattcaaaccaagctcaaaccagaactgaaaatagagattgcaggaatccttttctaaactgctttgccctttcctctcactgccttttatagccaatataaatgtc

SEQ ID NO: 8353 - DNA, 642 bp, Homo sapiens
ccgaggtacatcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcagttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtgggatttggaaacgggaattaacaaaattgctgcaccaatgcactgagtgaaggaagagagacggaggattaaggggtttagacaggactcctttcatatgccatcaaagagaaagatgcgccttatcccagttaat

SEQ ID NO: 8354 - DNA, 338 bp, Homo sapiens
  misc_feature (1)...(338): n = A,T,C or G
ggcaggtacactagaaagtcttttacaanaataatcatccttagatcaaccagaagaccaatcttcaatgtncgtcctngacagagatgggttacnntttaacatccctcctcctggttttcgtcccaatgttcctcctttaggtagtggcgtggtaagttggttgttggtggattgccaccccccctcggaggaatgcccttgcccataaggtgcctctgggttggcccactggtaaggtcctgcaattatcccctggtccaataatcccattagttccccaataggttaataccccaagttataaattcataatcccgccccataggcccacttat

SEQ ID NO: 8355 - DNA, 498 bp, Homo sapiens
aatcgattgaaccgggaggcggaggttgcagtgagccgagatgcactacactccagcctgggcaacagggccagactcatctcaaaaaaaaaaaaagaaagaaaagaaaagaaaagttaagtgcagagaatagtgcctgacacacggtatacagtaggtgcaatttcagtattagttgctactattgtcataatcatcagagtgtttcaagagctgtgcctccatggctctccacatcgcttcacaaactcccctgttctgggacccagcctgaattgtaaactccacccccgactgatgctaccctataagccaaacagaatcatggctggggtaggggctctaccctttgggatctggccgaaccaggaagaggtagagtggcctggaggccaaccacaggtgattcagaatgttcaccacgtggttcatcctgtcttactcctgctttacacgagaagccaccatgactagtcctcctcctgcggggacagacct

SEQ ID NO: 8356 - DNA, 242 bp, Homo sapiens
tgggtggatggatcagtggacaagttagtggatggatggatgatgaatggatgggtgagttggttggtggatggattggtggacaagtgagtggatggatggatgaataagttatttggggagacaaatggaagggcaggaagattgatgctccgcatgttcctggctttctgcactaactgtactcgacgtcactagaaaaaaaaaaaacaaaaacaaaaaaaaaaaaaaaaaaagtctgg

SEQ ID NO: 8357 - DNA, 756 bp, Homo sapiens
  misc_feature (1)...(756): n = A,T,C or G
tttctttcacctgtcttctaattagagcctcttactcatctgtagcacgagtcatttattttgtctagtacaaagaatatttcgaatactcatgactaaagagctcaggagttctagctaaagaagaatcttgaagcattggagttttgaaaatctgcataaagattttgaagattttttaaagattcatattataacagtataccgttggtctaatttttcttaatctactaaaaacgaaatagcacaggtcagatgtgacttgcttgctttctgctcctgtacaatccaggagtgttaatcaaaaagcaaaatttgtgacatcagttttatttccatggctactgattgtaatattacaaacatgagattactggctagttcatcatgaaggttaaagaagattcctccttggataggatctccaaaaccaacaccaaagggaatattatcagagctgcttccagcagcgtgtcctttcaaaaatgttctcattattctgagagctttgttttattttgtgagggttttatcatttgttgttggtggttaatattttaattttatgtgcttgtttgttttatttattcctccaccccaggtgaccgtgtangaaaatggttattttagatgtnagaagcccctctgttaggaagcagtttctgccttcgtttaattcttcttccacaaataagatttattttggaacttcagtcaaaaacatctgtactttgtacaggacaaagatttggcttc

SEQ ID NO: 8358 - DNA, 370 bp, Homo sapiens
  misc_feature (1)...(370): n = A,T,C or G
cctaagtcacagttctgtcggactgtgggtagaagactaggagatggtgagtggagtgtaaggaccacatgccganagaagattgatagaaaccatgggtaactgtcgaatctgtcagtcccggcatgagtgtaattgctttctctggagggcctggcgattctctcctacccagtggctatgctttatctatcgagcttgtgcccggtctgcatttctgattatgttgttgtgtattgtgtgtatgtatgtattcgtgggaagagtgtgttcatctgaagcctgtggctgaggattaaggttaggattgggtaaagatcagaatatcacgtccagatatcgcagcgactccctgtggatagcccttggg

SEQ ID NO: 8359 - DNA, 626 bp, Homo sapiens
acactggctgctcggcagtcacgccggtggccggcgggagagcggggagaagcctgggtccgtctggctcttaccacaccatgctcctgcttccacatggcagagggacagtcagcaggtgtgcagcgccccagctcctacttgtctcaacagtcctaactggccatggccaagagttctgtcagggcaatcaactccctgacacaggccagatggacatccgggagaaatccatagtactggagctggttcagagccccacggaattaagtcggaataaaaccacgagagaaagaacattttcatgggccctgcacggagcctcctgggcctgatggagaggggccccacccagaagagcacagggctggcccccacccctgcaccacacatgcgctttatcaactgaacactcccacagccacacggacaggattcattcaagtctgtgtatgtctgagcgcaggagaagaggatctactgagctctagctggagcttcatccagcgatgattactaatctcgtgctccaatgcagctcccatcctctcgaaggggatggtcggcgaccggacgtctacgtcttggggcccgttccccgagctggggtatctctgacggcttta

SEQ ID NO: 8360 - DNA, 210 bp, Homo sapiens
ggctgatcgtgctcgaggaggaaaggaaccgtaggttcacgacattgggtgtatgtgctcggctgaggagtgaatggggcgaagcagcatctgttgggatcatgagtgaacggctctaagtcagaatcgcgaacagagcggaaagatagggcagcggcgcggagggtcgggtggcctgggatagcgggtcggcgggcatgctccgggggg

SEQ ID NO: 8361 - DNA, 338 bp, Homo sapiens
gcaggtaccaaaataagaggagcgggtgcaggtaactgatatttactgaatagtaaagagggaagcgtgaaggggccttggagaatggttaacagcatctgtttccagctcatcacaggtgcacagcataagatgagagttggctatggatgggcaaatcactgaaggtagatcaaagatgggtgctcagcgccagtcggtctcatcgatgcctagctgttatgtaattactggatcaaaactagatgttattagtataagatatatgtcagataaagatagtatttaaaattgtgttgtaagataagagaacacatacaaaaatgtggattcttaca

SEQ ID NO: 8362 - DNA, 578 bp, Homo sapiens
ggtacatcagtctcagattcatcccagaaaaaagaagagcacaattattctctttttgtctccgacaactggggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatgggatttatgcagtaaagaagtctcggagaactgatgtagaagacctgactccaaatcctataataatcctccagatatgcaatgaacttcggaaattgaattaggtgattattgatctgacttc

SEQ ID NO: 8363 - DNA, 194 bp, Homo sapiens
gagggtatataactaggggcatgaagtgtgagctatcgttaatgagaatgacgtttggtttgctatcgctatggctaagaatgggattaagagaggaagtggcaaaaaaagaatggacgtattatgaggttttatgccggagcgactgaatatacaagaatgggggagaagaagctttttagatgtccttaata

SEQ ID NO: 8364 - DNA, 226 bp, Homo sapiens
cgagtactaaaatatctagttgtttgatagataacttaaactcattaatgatagatcgtaaagatctatagtcagtctcacaacagatgaggtattatttgtatgtaagtttcagcgtttgtgattggtttctcttttggaataatgagagaataaagtgtgtattcttgtgttttccctgataaatatgcataaggggatggggttaaacagtgttgaatatctc

SEQ ID NO: 8365 - DNA, 306 bp, Homo sapiens
tactgaaagatatagttaaaagatcaataacttaaatcagaattaatgttacgtaaagtcttatgtttcacatcaacacagatgaggtattataagtatataaaagacggtgtgtggggaaagctaggggtaagtatataaagtgagaattcgggtgttgtggagtgagtgttgtggtatatgtgcatttgggttggggtggtcaagtggtgcatagagtgaggaaaccatttctgcttggggtaatggcacatctccttgcgcataatggtattgaatatcatatattctatggagaaagaagtg

SEQ ID NO: 8366 - DNA, 290 bp, Homo sapiens
gaggtactgaaaagactcagtcagccccatcatgactctgatgaaaagagaggatatgttcagaactatggtcagtatcttccctgtctaagggattataagtatcttcccctggcagagctgagggggccataggtactgatctacagtgatcacagtcttggtgtgtagagagtgatgacagctagctcgactagggagggagtgccaaaaggtgaatatggtgagagaagcctgtgtgctgatggatgtttactcatctcctcggacgtggacgatattcactatct

SEQ ID NO: 8367 - DNA, 290 bp, Homo sapiens
aggtgcatattgaggctacttagaggaatgtaagacaaaatcctgtgaataataagcatcactcagaaccaacagcgaacagatgtagtgttgtagagtggataagtactacaaggctcacaatactacggattattattattaattggtcttcgtgaatagaaagtatacggggactacggagaaaagattgctactgagtcatgattagttataagaggatgagtaacaactacaatgtgttctgactcattgtgtgacccagcaccatcaccattcctatgcatctc

SEQ ID NO: 8368 - DNA, 466 bp, Homo sapiens
taccagcagagtcagtggggctagttgttatgtcctgtatcagtcactggtgatgggcctacctcataggagataaagattttctatgtagatgcaagtaaagtgagtcggtgtagaccagaataatcctcttctaaagaagggtctatggatgttctagggagtatgatctctctgatgaaagatcaatagttgtctagagtagatttttatttcttgggatgttgaggtgggaggatggttagatactataaggtagcggttgattgagtcgagattgtgtcaatgcatcagacttgtgtgatagagtgagacacttggtctgtttggaatctggatgatattggtcgtctctttctgatggtcgttgtttctccactgtatagatcatcatgatagcatttggctgagtaatatatgatagaagcgctgtgcgggagttggaggatagagatgaatcggggta

SEQ ID NO: 8369 - DNA, 194 bp, Homo sapiens
gggaggtaaaataagagggaggagggggtttagggaaattgattttagtggggtatatagaaaaaaaaaaatttggagggagaagattaaagaagttgagataaataaaatataaataagtgtattaaaaagaaaataaaaaaaaatggttaaaaaaaaaagtaaaatataaattttgaaaataggtgaatagt

SEQ ID NO: 8370 - DNA, 226 bp, Homo sapiens
gaggtggtggttgaggagaggttataagggaaaggataaagaaaatttattttatttataaaatggagtttttcaattttaatttggaagttagaaagggataaaaaaaaaaaaaatgatgggtataaataaaataaaagaaaaatttagggtaaaaaaggttggggattttgggatttgggtttgaggttttgaaaaaagggaattaaatatttttttataagat

SEQ ID NO: 8371 - DNA, 210 bp, Homo sapiens
atgaacaacttaaaaaaaatacaaaacctggatcaatggggcttctgggaaccgcgtatcttcccctcacccaaggcagtgggcatgaatctacttttaaaaaatgattaattttggccatctgagaagaaaagagcctaaaattgggtgatgcaacgagaaagtgaaagtcgagggaaaatgcagtttacaagtctctgaaatctaatg

SEQ ID NO: 8372 - DNA, 306 bp, Homo sapiens
gtacaaatcttatgtggtacataataaacattgtaaataactaacattctttacacatcttcattggcctgctcatctatgtttctaagccaataggtgatgttttaaaattatgtacagtaggtgatgtgatataataacatgaataacatagagcctcagaattagggagtagtgatggtgtgaaatcgattatgggcatctgtatcccatatctgtaactagatattttttactagtaattcaacatgttttgatcttgaagtatattactatagtgggaataaaggtaataaagaaaggatc

SEQ ID NO: 8373 - DNA, 386 bp, Homo sapiens
actttcaaatagctagttggatagtttgaattgtataacagtaatacctggataatacttactcgtatatgcgtgattaatacactctgaatcatatagatagtgattgtatgcatgatctgcgagtcattggttaagagctgaacgactatgtggacagtatgttaaacatggaaaagatggaacacaaaagagaaaaggatcccaatgagaaaaataagaatgattattagtattgcaatgtgaaacttaaagggaagaaggaaaagataaaaacggattggtattactgaatcagttgaatagaatcggataaaaaacaagcagggatagcggatcagacatgtagtaaaagcaactcgcccgatctggccgcaaaaagcacc

SEQ ID NO: 8374 - DNA, 530 bp, Homo sapiens
atttatttcattgctgaccattaggttgcagcatgcaactctcaacaatgagctgcccctctccactcctatagaagctccaaatactatggtaccactatgtaggttttcagcctttcaaaggcttttattattaacatcatcattacagaataaacattgtactaccctcagggaccaaggaagtacatagggttgttttccttttcttaaaatagccccagaattatgtttgctttttatagcttttttaatctctcttgtcacttcttgctattaatggtgctcctgcctctgggactctgccggccgcctccacccacgacttaaacaacatctcaccaattgcaaccggatcgtgggtgggacttccgctatcattttaggctttactaccaccatctcctcgcgggcagtgggggcaaccgcgaagacagaatttcacaaactttcagctccagcagtttcaaggaaatgttaaatgagaagatggaagaccgagtgtgaagagctaagaaaacaaaaagggg

SEQ ID NO: 8375 - DNA, 335 bp, Homo sapiens
tgaagggtgagctcctgggacctcagacagatccttccctctgatcctgccctgttgttggtatatctggggagtgtgtggcccagagaagccagtgatatatccaggtcacacagcaggcctgggtctagcatctgtctcctggcctccaggccattgtactctccacagcacaagtccgcctctcaggttcttttatttacaatgaaaccatttacttacacagttatcgctgcccactgggcattctttgggcagggagatggagttttgttaggtgggctctgcatacctatgggaactcagtgatgtaatgcaaagaaaaataaacttac

SEQ ID NO: 8376 - DNA, 482 bp, Homo sapiens
ggggggtggtggggagacgggggctttggaaaggaagcgccggggagaccactggtgttttagcgagaaggggggagcctaattcaaagccgggggggcggagccgataatagggtgtggggggggctttggggattttcggtgtgggggggggcttccattttttgggggggggggggggggtgagcggcgactcctcggaaagaaaagcgggcctggcggggggttggggggaggccaagtccggggggggggggctgctttttttcccggggaaaatgggtgggggcaaaaaagggggggggggggggggcttttgccgctggttaatttgtttcccttttcttttaattcgcccgggggagttttttttttttggagaggagggggagtaaaaggttatgcccgagcggcaacaaatattttgacagaattgcgccgccttgctcgtgaacaaagagaaaaagaagaagaaaaaagac

SEQ ID NO: 8377 - DNA, 322 bp, Homo sapiens
ggcccacccgcggtctctggccacctgttgccgtccatcacggggccacccttcttcatcctccgtcctgtacaatagctcagcaaagcggctggcggactggcccgggatctgctgctgctccagccatctacatgacaaccagagcctgggaggagctggatggcggcctgggcagttgctaagccctggaggactactctgtgctggccgagaccgaggaagacagggcttcagcgatactcaggctggccgacttcggcagcgcgccccacgactttgaggtggctgaaggctggcatgtggacaccaggaccaagaa

SEQ ID NO: 8378 - DNA, 162 bp, Homo sapiens
ttagtttggttgtatttttagattatggtataataatttgaaattataaatataaataagtagttagaaagggtttgaattaataatttggtgaacggttttaatcgataggtgttgattagatgaaagttagtagggtgatgtttattatggttgatagtt

SEQ ID NO: 8379 - DNA, 258 bp, Homo sapiens
aaggatgcaactcctgtcttggatagcactacgtcttgaccttgctcaaaacggtgctactaaatcaagtactacacacaaaaatgactggcaagaggagcatgtactgctggatttatagatgatttggaatggaatttttacgttctagaatccctaacccaccaggatgctcacatatatgtttgacatgccacaagaaagacacagacaatgaaacatcttcggtgtctagaataagaactggaacgtcgcgag

SEQ ID NO: 8380 - DNA, 162 bp, Homo sapiens
tattgatgagatctcccatatgatacttctcagtcatgtaccattttggatattcgctctttcactgtatatattgtgtcttgtgtttggagtgtaagtctcagatcagaggatctgttgagtctatagcataaccaaaatggagctgctaggatttattca

SEQ ID NO: 8381 - DNA, 210 bp, Homo sapiens
  misc_feature (1)...(210): n = A,T,C or G
gctactagttatcctactaagagaaaaggcaacatggacagcttcaaatttcgcaatgtaagactagccattaactggggcctggacgtgcgcggcttaactttggacataaccacatagcgataaattttacgaccccagtgaaaacaatgatttccatacccagctcttattccttcaccataaagattctgtgtnagcaatttaaaa

SEQ ID NO: 8382 - DNA, 562 bp, Homo sapiens
ccatagtccctgcagagatgaatccaggtggaagaatgcagaaaagctttagaaggcatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcacgaaattcaaaagaaaatgtgggacgagttagatctatggcattccaaactaaatgagctggattctgaagttcaggacatcgttgaacaggacccaggagaggctcaagaatggatggataaattgatgattcctttcaagcagtatcagcaagtatcacagagagcagagtgtagaacatcacagtagaataaggccacagataagatggaggaatatagtgaccttctgaagagcactgagggctggatagaaaatacacgtcatttgctggccaatcctgctgactatgaatctttgggggcactgagttaccatggtagcgatgtgcagatgggttaggaagaatcaccagcggaagcaa

SEQ ID NO: 8383 - DNA, 242 bp, Homo sapiens
actggcagctacgagcaaggccagcccgcgcagcacctagatagaaggcacgtggctgcatcccgacggttacagcctcgcgtctttcgggactcgctttctcctgttcgcgagtcgtgggctctgggcgctttatcccgaggaatactatgacagtggacatcaaaccgagcgctatagcaaggcagaacccgaggagggagaaagacgggagccggtccttgaaagcgccaggagacagc

SEQ ID NO: 8384 - DNA, 697 bp, Homo sapiens
tggctgcgcactcggcctgagaaactcggcaagcgcgcagtgtcgactccccggtctatgccaggcgcatctcaggaacgaggtctcactatattgcccagactggtctcgaactcctgggctcaaacagtccccctgcgttggcctcccaaagtgatggaattacaggtgtgaatcactgcatctgactatggcaaggatctctgtcactgaggtaagtttggcttagagattaaagctccttctatcttgtgatgccaccatcacaaggttctcaaggttgttgtgggagaagagaaggctaaaggagctcatagaatgcctttaatgctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactagggggataaataaaagttcggaggcagatgaggcaatgaatatgaattctgagaaaagtatggattggaaattcaatgaattaatttaatgaaattaaatgtgagaaaaaagaaagg

SEQ ID NO: 8385 - DNA, 386 bp, Homo sapiens
aggtgagttgggagtcagttcagaaagggcagagggtcccacaacaggaccagaacccagcgggggaacctggagagccccctgcgtgggccaacttactgttccatcgctcacccacctcgcgtccacagagagccctcccacactgcctggcctccctggccaccaaggcgctgccagaagacaaggtcaccagataatctgtcctcagagagggctgagaacccacccggggcagtatggaggaaccctaaagagggagaaagcaaaatgggtgagagtccaagggagggagggagagagagtggctgcagcgggagctcagaggagggaggaggctggctgggatgcacttgtcatgggagcaggtccagggcgggcaattc

SEQ ID NO: 8386 - DNA, 418 bp, Homo sapiens
gacaagcataagtacatactggaattaaaatactctaagaagaagaatcctaatgcatgccaaataagttctaaatatgctaaaccagccttcaataaagccatatgaccaactgataacaacaatctaaatactatacaaggtaactggcgcaagatttgatggagaaaagaccttcacatcaccacctcagtccttcacaggccaggtcctcctctctctgagacagtagggctgaacccggggacaccccagagccctgtaacacgcagccagcagtctgctgagctcgttgtgcagacgacaaagggaacacagaacttgggtctcaggggctgggcaggcagatccaagcatgagcaattagatcaaaatagaagccttgtttcaaagaaaaaaattgtattcttctaagtga

SEQ ID NO: 8387 - DNA, 370 bp, Homo sapiens
ctgatggcggtagcagcgcccagtcgagcacggggcagcggctgccgggcagggtctggtgcgcgaggggctggggcggaaggtcgagagggcgaggactgtggcaaggtggggctgctgctggagccctcatttgagatcgatgacagtgacaacttacggaagcggggatcaatgatctggacacagcaggatggtaccttgtccctgtcacagcggcagatcagcgaggaggagcggggccgactccgggatgtggcagccctgaatggcatgtacagggtccggatcgaaaggcgaaccggggcacctggatggactgcaagctggtggctatgtctcactcctaagtcaatgcgtgacccccgct

SEQ ID NO: 8388 - DNA, 226 bp, Homo sapiens
tactcgaatcgttgtgattgttggctgaatgtttcaggctatatatgtaagagatagtacatacatgtcttattcttaactccaagaatgcgtactttaggtgagggtattatgaatatgattaatccaccatgtaatcatgactattttagggtcattattggcgggtatggtgtatccatagtatcctctagcttctggcaaatgatggtgactgctgtatcta

SEQ ID NO: 8389 - DNA, 274 bp, Homo sapiens
aatgatgttggattatgttgcctgagatagcaacagagggataggtggggcggtaaggaaggtgtatgatcttttcgctatggcggttaccagtaatatccaggatcctattatcgagtcactcgtctacatatgtggctgagggcaatgctgtaatgtgaaattcgactgtatggtggtaagataccatatgcctgcggtaacccttcgatatactctggaatagtactgatttggttcgtttttcaaaggtagagcttgactcgacgaaccc

SEQ ID NO: 8390 - DNA, 162 bp, Homo sapiens
gtatcgtgattgtgaacagattatggtgcaagtgttattgaagaatccaagtgaagtaagggacaggcggtgtatcactcaaaccagtgggataacacaggtaccacactacatattccttccgtaggctggatacaccatgagtcttgtcatagaacagcc

SEQ ID NO: 8391 - DNA, 194 bp, Homo sapiens
  misc_feature (1)...(194): n = A,T,C or G
atgtctgtcgtctccatacatactggggtgtacagtagatgtgatgtcagactcangatggttatgtagtataagactgtttaaacctgctgccatttgattgacttcaacagaanagtagtactcccactatcggatagtttcagtgagtgataatagctggctcggatagatgtcatggattcatcccagtc

SEQ ID NO: 8392 - DNA, 162 bp, Homo sapiens
ataaaatgaatggataagagtgtggataaactaagaaggaaggagagggtaaagagatgaagaagattagtgatggggataggggattgaaattattagaaatgaaagaggaatagaaagaaaagtgaaggtattaagattgagttgataaagtaaaaggaa

SEQ ID NO: 8393 - DNA, 258 bp, Homo sapiens
agtgttagatttaaggtatcttatgaacagaagtaaattagattgataggaaagaaatagtaatggagtttgagtaaagaaaatgaatgatgtaataaaaaaagtaaaaattgttgaaaatgtgaaaggtgagagtgttataatggggaatgtagatatagaggtaatttaatattggattagagtattagatataaaaaatgaagtgaaatgaaaattatatattaataataggtgataatggtatgtatttgttat

SEQ ID NO: 8394 - DNA, 242 bp, Homo sapiens
ggtttggacacctgggggggcccaaacacagggacaaacattgtgtgcggctgtcgcttgaagaaaagcaaaatctaccgggagggctgcgcgcagggccctcaaaaagggggggcaaaacaactttattttaatagggggtattggccggggggtgggcttactcgaggtgatcttggccccgcccccacccgggatgggccttaaatccataaatggcctggcctttttattgcggtcct

SEQ ID NO: 8395 - DNA, 386 bp, Homo sapiens
tggaggaacctcaggaaactcgcccgaggtcacagagtgggtaatggagacagcaaacatgtgccgaccacttagtgcacaccaggttcctaagggctcttcagaaccctgaaataatcctgtggagcagatgtgatatagacccgtatttcaaatgaggggatttgggctgagggtggttacgggacttgcctgaggttaactgaggtaacaagcaccagagccaggattcgaaccaaggccatcggggtcacaggcacacactaccccccttcctctgctggctctgacaactcaaaccgggctgcagcatgggtgtgctctttccaccaagggacccctggggtggggctgtttggcctctattaccgctccttatttcttat

SEQ ID NO: 8396 - DNA, 290 bp, Homo sapiens
ggtttggcgcatggataatgagctggacctacatgatgaatagaagcagggatgatatgataaaagacgctgggcttttattgatctggggctcctttcccgggggagtccggtgagtccctttccaggtgggtttgcactcacacgagtgggcgggattatcatccacaagctggccaagcccctacctgtgggaggcttgatggcagggcaccatggctgaaatacacgcttgggggaacagatcaagaaagaaactacgcaccaaaagtgagcggggcatgcaccca

SEQ ID NO: 8397 - DNA, 162 bp, Homo sapiens
tgcatccctgaacacctgtctgggggcggggggtggtgggggagggagacctcagccgagggactctgacgagatttggtgatgtcctacgggcaggagtcattgtatgggggtgtgggaacagtgcctagaccacagggcacggcctactcagaaggtgga

SEQ ID NO: 8398 - DNA, 226 bp, Homo sapiens
gaagagccctctgctggccaaccctgttggaagaggacactggggatgggagtggcgaggtgcagggccgaccggagacaccggcagaagaagagatggagacagacacggaggccggagtgtctgcggaaaaggagggggatgacacaggtgccctgctggccgacttgatcgactgcgcccctgatgatgagaagccagcacctcccatgagacccgactccta

SEQ ID NO: 8399 - DNA, 162 bp, Homo sapiens
accaaacaaactacaaaaggactcatacgctactagccgtgagagtctctcttgctgtgttgacgatgacgagtggtggtttctgaacctgattgacattgatgaaaacggatgcatgtaccataatgcgtctacctgacatgtgggttgcgagcacataga

SEQ ID NO: 8400 - DNA, 354 bp, Homo sapiens
  misc_feature (1)...(354): n = A,T,C or G
ggaagcccgtaagtccaatatagcagatgtcagcagacccagctttgcctgcaagctgaaagaggagacccttccttgcttgtgtctagcttctggtgatcgtcagctgtcctcgggatcctgnggttcgcggcacgtcatgaccatcttggctgctggcaccgcggggcatcctcctgggtcttcacactgccttccctccgcgtgtctcaggctctaaattagccctctactaataaggatgccaatcactggattagggttcaccatattctagtacaaattcatcttatatatgattacatactgcaaagatcctatttacaaataaagattaattaataggtcccaagg

SEQ ID NO: 8401 - DNA, 226 bp, Homo sapiens
aaactaaaagataactcgcgagggaaaccaccaaaaccacaaccctaagggcactgatgcaacccctcaagaattgtagtgggaacacaggtcactgccaccaattctcgttgaaacatgactcttcatcttatggaattcatatatatattctgcaaggacgaggcagcgaaatgtgggaagtgacgacactgatggggaacactgggactgaggtcacggagca

SEQ ID NO: 8402 - DNA, 386 bp, Homo sapiens
gccgcccctggcgaactccattgtcggggggcctctaccagccgcccctggcgaactccattgtcggggggcctctaccagccgcccctggcgaactccattgtcggggggcctctaccagccgcccctggcgaactccattgtcggggggcctctaccagccgcccctggcgaactccattgtcggggggcctctaccagccgcccctggcgaactccattgtcgggggggctctacgagccgcccctggcgaactccattactgggggggcgttacgagccgccccgggtgaactccattgtcgggggggccgtataaaccgtcccggtgaacttcattggtggagggcctctataaccaacccctggcataattcaaggctta

SEQ ID NO: 8403 - DNA, 354 bp, Homo sapiens
ccagaaaggcccgcacctggggaagctggcgaacgctaaccgggaggtttttcttccagacttgattccgggatgttgagatcgttattcgaaatagactaacattcgaatcgcctgtgatggaaggagtttctgcacccgtagcctggcctcatttattctgcaaatgtttattgggtccttgccctttacaagatcctgtgctgtgagcaagaacaaggctttcatgtggaaataagccggcctttggttgaccaaaccgaaactcctctgaatggaaaatcaagaaaaatttggaaaaaataataaaatgttcaatgaaatggatataaatattttcttgtttaagtaggc

SEQ ID NO: 8404 - DNA, 402 bp, Homo sapiens
acagaacgagactccgtcttaaaaacaacagcaacaacaaaaagatcttgatgcctctgatggagctgaacatttattatacagcaacagcagcaaggattgctggtgggcagactacactgtagggcacctgctcttctgtaagaatctgaaagacactattgtcagagctctgcccttttggaatgaagaaataattccccacatccaggaagggaaacaggtgttgggtgagggctctggcagcagcttttctggcacagtcgagccttgggagggtctcccggcaagggccatcatggagctgagcctgcccactgggtttcccattgtctatgaattgtacaagaagaggctgaagcccattgaagctcatgcaggtcccaggagaagaaaaaggtg

SEQ ID NO: 8405 - DNA, 450 bp, Homo sapiens
  misc_feature (1)...(450): n = A,T,C or G
gtgtctngacaccctccanaancaccaggagnagaaacagctttccttggccttcccagccaaatctccctctgcctctctcccctggtgacgacaatggctggggtcttgacttgccaagatctggaaacggagaaaggactggatctccaaacttggactgccttggactgaccctggcctgggaagtgtgggctcangactccgagctcaagtcagtctgttcccccaacccccaacccactgcatccgggtgaggaagtgggcgcgagcgccacagcgcacataggggtgttaggagcgaaagactggagacccaaggactgtggggctggggtggtgggggcactgctaccgactaaacaagtcggggcgggctggaaaaacgaagggggattcggtgatgggggaagccaagggacaagggaaaaaggaaagggcgcattcttg

SEQ ID NO: 8406 - DNA, 450 bp, Homo sapiens
ttctcttctgtaccttccctgcacagcctcctccccagcctggatccacagccaccatcccatcacttgcctgctgcaagtatcctcagcactgcgcacctctctcccagctggcagaaaccagccctggggaatccaactcctggacttctctacacctgcacacaggttggcaggagttgccagaggtcttggcacagcagcctggctggaatcacagagcaatcctcaaccttggccaggccctcactgcccacctggcaaatcctcaagtgtgaccctagtcatctttctccttttggggtgtttcagactttctccacaagtctcagacaagctcaagtcactcccacatgaaaaataaaaacgggctgggtgtggggggtcatgcctataattccaacctaataaatggtaatggaagaattcctgggaaaaaaaatcttaaat

SEQ ID NO: 8407 - DNA, 530 bp, Homo sapiens
gacaggacgagactccgtcttaaaaacaacagcaacaacaaaaagatcttgatgcctctgatggagctgaacatttattatacagcaacagcagcaaggattgctggtgggcagactacactgtagggcacctgctcttctgtaagagtctgaaggacactattgtcagagctctgcccttttggaatgaagaaataattccccagatccaggaggggaaacaggtgttggttgaggctcctggcagcagcttttctggcacagtcgagccttgggaggctctcccggaaggggccatcatggagctgagcctgcccactggtattcccattgtctatgaattgaacaggaggagcttgaagcccattgagctcatgcagttcccaagagacgaaaaagctgtgcataaagccatggaagcgtggcttgcttagggcaggggcggagcgtgaaaggcggcagccggtccctatcctgacaacaccctcccaatctgccccattcctctatgcctctcacctcaacgtgtc

SEQ ID NO: 8408 - DNA, 194 bp, Homo sapiens
ctcttcttggctgcagccaagattctgggggctggggtggcgggtggaggtggggtaggagggataggaaaggcaccgggacaggcacgcgaaggagggagccgcggaacaaactgtcggtttcagcaggcccccacgaaaccgcaagatctgcaacaacgatacacagcaagccaaccgacgcaggcagagga

SEQ ID NO: 8409 - DNA, 562 bp, Homo sapiens
ctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaacagaatgcagctccagcttaaggaagcccaaacaagccacccagggagaacaaaacaccgccagcgtggattttccaaatttccctgggaaga

SEQ ID NO: 8410 - DNA, 530 bp, Homo sapiens
atttttaaacatccaaatatctgtaacatctgttataacacttgacatatgcaggtcaataaattaaactattgctttgggagaaatgtgcctgaattgttcactataagtctctgccgggagttattcattcaagtaaacaaaagatggcctatttctgaaaattaacaatgcgtagactggactgtaagtcgtgattccgtattttctcgagttactagctccatcattagcaacatgagaatgtgcaatgccaccatgttgaagtatgattaatcaacatcttttctgaaacaaagattttttttcccccattgcagaatttgatacaagaggtattctggttccttggggggctgaaaaaatctggtttacgctggttggaaccggggaattttctggggttaagctttttgctgggactaaaatcaaaactgcactgcagagcaggtgagggttcatgcgcgcgcgcccacaaacacacatatagagaattaaaaaaccatttgccatccatatgggaatattta

SEQ ID NO: 8411 - DNA, 472 bp, Homo sapiens
  misc_feature (1)...(472): n = A,T,C or G
gtggagtgtattgtagcatgagattaaggttttggcacatggggtggagtggggaccgaatgggatatctcagttttctgttgaagcctactatagacgttcctgtcatcgttcgactctctctcacgtgcgcactgccacgtgtgattagtatgtgaataccaccggtgtatgggattcaatggatatgcttgacgttagggaagagatacttatagtaatggggagtggacaggggatcttaatgatgcgagcctgccaggcgggaagcgggcagacttgcgggttcttcatgaatgcagagggtgttgggattggggggcttactgccgcgactgtctatgggaatcccatgagctggcctctactgatggaatatgctgtaaagaatgacggggtatggggatgggtanagtttgaaatttgaaaaaaaaaaaaaaaaaaaaaaaaaaaaaaaaaaaaaaaaaaagca

SEQ ID NO: 8412 - DNA, 854 bp, Homo sapiens
tcacctgtcttctaattagagcctcttactcatctgtagcacgagtcatttattttgtctagtacaaagaatatttcgaatactcatgactaaagagctcaggagttctagctaaagaagaatcttgaagcattggagttttgaaaatctgcataaagattttgaagattttttaaagattcatattataacagtataccgttggtctaatttttcttaatctactaaaaacgaaatagcacaggtcagatgtgacttgcttgctttctgctcctgtacaatccaggagtgttaatcaaaaagcaaaatttgtgacatcagttttatttccatggctactgattgtaatattacaaacatgagattactggctagttcatcatgaaggttaaagaagattcctccttggataggatctccaaaaccaacaccaaggggaatattatcagagctgcttccagcagcgtgtcctttcaaaaatgttctcattattctgagagctttgttttattttgtgagggtttttatcatttgttgttggtggttaatattttaattttatgtgcttgtttgttttatttattcctccacccccagtgacccgtgtagaaaatggttattttagatgttagaagcccctctgttaaagagccagttctgccttcgtttaattcttcttccacaaataagatttattttggaacttcagtcaaaaacatctgtactttgtaacagacaaacatctgccttcctaccagagctgctggccttgctgatgttagataaatgcattttgttctttgaagcccctcatagagaagagactgtaccataagagaagcccactcattttg

SEQ ID NO: 8413 - DNA, 594 bp, Homo sapiens
  misc_feature (1)...(594): n = A,T,C or G
tggctcctnagacttgttacctcaagtagagatgttgggtggacaaccccattcccatgccaggcattctctccactcatcaaaccacagtcttctgctctgttttctgtttgttttgttttgtttttttgagacgtagcctgggcaacagagtgagactctgtctcaataaaaacaaaacatacaactacttttgcgggatgctgtgttttactgttgtgttgttttggatctaacacgccctccagtttattcactcttagccagtttttccagccatatcttttccttgaatatgtccagacaatatttcatggatcaaaatattaacaaggataagatgaaaatgataaaaccttgtgcttttcattttcctacacagttttctgcatgtatcttgtataactacataaggtatgttagctaaaaaaaataaaagtgtgtgtttgcagggaagcggaggcgggggcgcgctggtgctgagtggagtcacagtaaggctgtagatggagcgccctgggaagggtggtttttttgggggtttgctcaccccggggaaggaggagtgagggtttgaggatgggtggaggggta

SEQ ID NO: 8414 - DNA, 162 bp, Homo sapiens
  misc_feature (1)...(162): n = A,T,C or G
ttgntggtgatctacattagaggggtaatattattattttttcattcttctgttatggaaatgtaaattattttactatgtttctttttatgagcattgtaaagattttatgaatgttattattcatgtatgtttatgtctatattgagatagtatgttggt

SEQ ID NO: 8415 - DNA, 466 bp, Homo sapiens
ggtaatatgttggatgagacttacatagaaggggtatattttgataaataccttctaccgaaatggaagagtaaatatatataacttgaaacattttatgagcattgaagacattaaatgaatgatattattcctacatgtttatcgctatcctgagatgagttgttatgggtatgttacagtagtaacacttctgaataaataattgcagcattctaccatttaggtttatagggaatagctatggagggacggacactcttgacatgaaacttataaaaggacagcgtgagagactaaaaactacaggcctttctctctcaagaacatagatagatgaactttaaacataatgcttgctaactttatcctagcgacagattaaaagcgcctttgggcctccatctttttttgttggtggggctattgttgcggttggtgtaggcagcaacccagtctccttctg

SEQ ID NO: 8416 - DNA, 226 bp, Homo sapiens
aataggcaggttatgtggcttattactggtgagcgaataatgtaaacgatgagcgaggccggggtgcaggctctgcagggctactggtgaggcacagagtacaaattgacatttcactatgtttgtgtgggcagacacttggaaggtgtctcaccgctgcacgagtgtgaaggctgtgcatagatcattctggcgtcctgtgttgagagcagcctaatgctcacgg

SEQ ID NO: 8417 - DNA, 274 bp, Homo sapiens
acatgggtgaaagaacatctatttagtgtggagcagataacagccatgttgtttgactaaacgtgaaggaaaactgcgtggaaaacagccctcaagaaaacccagtaacagcattgtggttattttcaggtccccttcctttcttttacaggatgctggagaaggcgatcctgtgttaagatgcctgcacaagatttggtggccttaaactgttttaagacttatgaaatgacaatgacagcctgttgctttggaattacgggattttaataag

SEQ ID NO: 8418 - DNA, 290 bp, Homo sapiens
ttttttttttttttttttttttttttttttttttttttttttttttttttttttttttttttttttttttttttttttttttttttttggggagggggtggttttttggggggtttagggggaaaagggggggggatttttttttaaggtttttttttgaaggggggggttattaaaaatttgaaaaggggggaaagagggtaaaaaaatggaaatttaaaatttttttaacaaatattggtggggccggggcgggggggggggggggggggccggaagtgacaggagtg

SEQ ID NO: 8419 - DNA, 162 bp, Homo sapiens
gggggaaattctgagcctgtcagtttggaattgaggtttgacttgtggaaggtggacttcttgtgtatttgctgctgctgcttcatgctggtttgtgtgggctacctggttgattatcttgcatgggtgggtgttgttggtggaatttgggatcacggggtg

SEQ ID NO: 8420 - DNA, 210 bp, Homo sapiens
attatggaaacatgaagctatttaggggtttttttcccataaaggaatggaaaagtaatccttttttattggaaaaagaccattattttaaaaatttattgtttttctgtgtataagaacatcagttacaaatgaaatgttatcaaattaatatcctatgcttactaagtccaccttctggtccttatttacaaaaaggggccattggcc

SEQ ID NO: 8421 - DNA, 242 bp, Homo sapiens
attatggaaacatgaagctatttaggggtttttttccccctaaagggaatggataagtaatcttttttatggaaaaagacaattatttataaaataaattgttttttgtgttatagtaacatccagtttaccaatgtaaatgtatatccaatataattatcctatgcccttatcacagctctactctctctggttcttcatacacaaatagtggctattggttatccttttgtcatctcaac

SEQ ID NO: 8422 - DNA, 194 bp, Homo sapiens
gccgggtcagggtacacctcacctaccccacctccagtcaatttcattttaagttcatacccaaactataagaatatgtaataaataaaattcagcaagttgtattttacctttaaaaatacacctatcttcccactttttgttaagttatttttaacatttttatgttatattatttcctatcagtggggaag

SEQ ID NO: 8423 - DNA, 210 bp, Homo sapiens
cgacctttataaaataacgactaaaaccttgttgtggaattatggtatatagctctaaagaaaaaattaatctgggattatatttagagttagtagagaagaataatagaaattttactttacataactataaaacatggtctattattaatataaggactaaaagctttcttggtggatcttcaacaatttaattctgcactttatata

SEQ ID NO: 8424 - DNA, 322 bp, Homo sapiens
gaggtactgtattatgggaaaacatgtaaggctatttagggggttcttttcccccctaaagggaatggaaaagttaatcctttttttatgggaaaaaagcacaatttatttaaaaaaaataaattggtttttgtgtgttataagaaacacccagcttaccaatgtaaatgtttattcaaataaataatctatgccttaggaaaggtctacctttctggttcttattaaaccaaaaagtgggcattgggtttccctttggtaacttaaccgccaggggttccatttgggaaatccacccaatcaagtatggtaggtctggcgt

SEQ ID NO: 8425 - DNA, 194 bp, Homo sapiens
tggaccggaggtaccagggtaggtagctagatgctgcttccttagcatcccacctgcagccttgacaagcttcaactatccagcagctcctatatcacaaaccgcacctacacgctggctaaggaagttagcttggctgataacaacacagacgaacgaatcaacggggagaaaccgatccatggagctaggtc

SEQ ID NO: 8426 - DNA, 402 bp, Homo sapiens
gtacaagctttttttttttttttttttttttttttttttctttttttttttttttttttttttttttttttttttttttttttttttttttttttaaaaaaaaacaaaaaacaaaggaaattaatggggggaaggggaaaaacggggaaaaaggggggaaaaaagggggaaaaaaaaggaaaaaaaaaaaaaacaaaaaatcgcgggggggaccaaagggggagggggggggaaaaaaaaaaaacggaaaaaaaaccaaaaccaaaaaaaccgggaaaaaaaaaaaaaaagcctccctctttcaaaaaaaaggggggggacggggcggggggaaaaaaaaacaaaaaaataaggggggcccgggaaatatcaaagggaaaaatcccacaacaaaacaaaccc

SEQ ID NO: 8427 - DNA, 450 bp, Homo sapiens
agctttttttttttttttttttttttttttttgtctttttttttttttttttttttttttttttttttttttttttttttaaatcaattaaagaattatgaaatttatttgggtacagggaataaccggggcaaaatggtgggaaaagttggtaaaacaagtttacattaaatttacttacaattacggtggggtacatttttggaaggggtgggtttttaaaaaaactggcttaaaatcccaaccttaaatattttggaaattaaatcattagcttttctttttttttattaaggaggggggcttgttcttgggtttatttaacttttacattaatggggcacttggttatcttatgggataattctttttctcatttaagcctccccacaaccttggaaagggattaccccatttttatggggggagaaacaggcttagaaggggaaa

SEQ ID NO: 8428 - DNA, 194 bp, Homo sapiens
ggcagaacgatctgcactctttgtttaggcatgttggcttgacaattaataactttcatctgacttttataaggaaacggacatgcttggaggctgaggatgcttaatggaatgataacaacacagacgtgggtatatttgatgtgacagtgattgacatattcagtctgtacgagatctgatgattgaatgag

SEQ ID NO: 8429 - DNA, 354 bp, Homo sapiens
  misc_feature (1)...(354): n = A,T,C or G
tctgactatggaaacatgaagatatttacgggtgtatgccactaagaggagaggaaagaaatattttttataggaacaataccataatcaaaaaaaaaaattgtttattgtgtataaaacacaagccacaacgaaatgacatgaaaaaatatttatgattangaaagggaatgttttgggtttataaacaaaagtggcattggtttactttgtaagtaacgaaggggttcatttggaatgcagcgataatgatggagtatggtttaccatatttttttaggtaaaaaaaaaatgctctggggcatataatggttatttttaacggggaaaggggggtagttattaattttttta

SEQ ID NO: 8430 - DNA, 226 bp, Homo sapiens
ttacatatgttgttagcataagacactggcgatgtaactgctctaaacaaaacaccgaaagttgtcctatgcaatatatattattatatacatatatatatttacataaaatactaaaaaagtgaaagccaataataacattggataaaagtaatacatatctgctaagtgacaatatcaaaaaaatcaaggaataattttacaataatataaataaaaagaatgt

SEQ ID NO: 8431 - DNA, 498 bp, Homo sapiens
ccccccccttttttttttttttttttttttttttttaaaaaaaaaaaaaaatcatgagaaatatttggggacagagaaaaacagggacaaaaagtggagaaaagaggtgaaaaaaaatttacataaaatatacaaaaaaatacgtgtggggacatatttgtaagggagggggttttaaaaaaaacgggtaaaaaaacaaaacttaaatattttgcaaaaaaaaaaattttctttttttttttttaaaaaaggggggggagtattttttgggttaaaataaatataaaataaaagtggaacttgagtattttatggaaaaattttctatttcttttatacctcacaccacccttgggaagggttatacccattttttgggggaaaaaacaggggtaaaagagggaagggggatattttgtgcgcgcaaacgctttatggggggaagatttggtaattgaacctataattggggcttctttttaaatataaaatattttg

SEQ ID NO: 8432 - DNA, 178 bp, Homo sapiens
gctcactgtagctacagcatagcagaccagtagagccagagaccctccattcaacacataatgggaaccttcctccttataaaggcggcaggcgccaccttcaagaagcgaaaaacctaacgcgacgcaaaagttatcacactaaacaggacaacctcccgactccactttgcccact

SEQ ID NO: 8433 - DNA, 306 bp, Homo sapiens
actgattgtggcaagcatgagctatattaggggacttgtcaaatagaggagtggaatgtggtaaaaatgatggaaaaagacaagtgcataaaaaggaaaatggcgtgtgtgtgtagaacaccagatacaatgaaacgtcatgcataaatatctatgcttagaaagcatacctcatggtcatatgaacaaaagaggcattggtgtaactttgagaagaacgcgggggctgatctggaacacgagaatcatgagggggacaggaaacccatcttgactatggggaatgaacatagctgagacggagcc

SEQ ID NO: 8434 - DNA, 194 bp, Homo sapiens
cggagtatggagaaatgaagctatgtatgtgattgatcccctaaaagaatggaaagttatctttagtatggaacaacacaattatatgagaaagaaaattgtagtctgtgtcttcaataccattatagatgtagagatgcgtatcaatagaatattgtatgcgttagaagagaaatacctacattggaccttat

SEQ ID NO: 8435 - DNA, 514 bp, Homo sapiens
gcacgattgtacatgcgtggcgccaatcaacaatatataacacgaccgaaaattattgttgcatgatgcatgtttgtgtggttgctcacactgcaaaggactgtataataggggatgaaacggtgctgcggtgacatgatgatggatcgtggtgatatgcatgattgacgagctgacactaaccatagaagatgtggtgatggattaatatgataagtcacagacaaagatgcaggacgtggtgcccgacaatgccagctatgacagcgcgctcatgacgtgtcatatcaagggtgatgacagtgatagccagagggatgctggatagcagatggaggcagggacaattggtgaataggagtggagagagcatagcagtaggagaactggagaagctgcggtgtgtctctgagtgcagctggaacttggacaagagattaggcgtgaggtgaacatcataccacctgcccccgccagacgtgacaatgataagccacaatgcgtatgctctcca

SEQ ID NO: 8436 - DNA, 322 bp, Homo sapiens
acaagcttttttttttttttttttttttttttttttggttttaaagtttaataatgaaaacacatggaataaagggggtaatccatgtattggaaacagcagaaaaaggaggaaaggggaccatccccataggggacactaatctttggggtaaactaaaataaataagggaaataacacttaatacaataataaagaaaaaaaaaaaaattacattaaaaaaaaaaacaggaacgggggaaaggagcccgggattgggaggaaaggcggtgcatggaaaagaactcaggttcaggggaccttcctggaaacattctggtgt

SEQ ID NO: 8437 - DNA, 354 bp, Homo sapiens
caagcttttttttttttttttttttttttttttgggtttaataataaaaacacttggaattaacggggtaatccaggtattggcaacagcaaaaaaaaaaggaaaggggaccatcccaaaaggggacacttatccttgggctaaattaatataaataagggaaataacacctaataaaataatacagcaaataaaaaaaattacattaaaaaaaaaaacaggaacggcggaaaggagtccggagtatgggggaaaggcgggtaagggaaaagcatccaggctcaggggaccttccctgaaaacttccgggttctgagcagctcaactcagtcccaggcataacacgtaccccgg

SEQ ID NO: 8438 - DNA, 258 bp, Homo sapiens
acctcaaactcagagtttcttcccttctttgattttctggaggacctgcagctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacctgcccgggcgggggggggaggggggggggagaaggggggggggggc

SEQ ID NO: 8439 - DNA, 290 bp, Homo sapiens
  misc_feature (1)...(290): n = A,T,C or G
tgtggtcaggcttatgaatatgctcangtttaatgagatgctctgttgtaatgtgataggctgtggaaacaacaatgagtggaatgacatcaatgatgccaatgaaattgagcatgtcaactagcgcatgaaaaatgggcatgatcatcaaagatggtgtgacggtccataagcgtgcgacgggccatacaaggactttgtgccggaagaacggcttggacatggggataggtaagcagatgggcatatgtgaggggaacggtatcttggctgctgacatcgcgatcgct

SEQ ID NO: 8440 - DNA, 434 bp, Homo sapiens
  misc_feature (1)...(434): n = A,T,C or G
ggtcggccngggtcaagcctgcgtatcagaatctgagacagcgtgttggcaactttgttgcaaatcacttggcaactcacacatggagtccgcatctcaataagaaccagctaagaaacaacattaaacaacaagtcctcaaatcaggaatgttggagtctggtattgaccgaattatttctcaggttgtggacccaaagatcaaccacacattcagacctcaagtagagaaagctgtgcatgagtttttggccacgctaaatcacaaagaagaaagaagtggcaacacagctcccgatgatgagaaaacagacacttcccttattacacaaggtgttcctactcctgggcccagtgctaatgtaaccaatgatgccatgtcgatattggaaaccataacttctcttaaccaagaaaacaaggctgctaaggct

SEQ ID NO: 8441 - DNA, 450 bp, Homo sapiens
gacgggctccacaaacaatcacggtgtggcacactcaaactcacctacgcagaacctaaagcggtgtgtgaatttgaacgcggacatatgtcatattagaatgaaatataggcattctgaaaaattgtatttctatgtgtagagatgaaggaaggatgggtataggcttagcttgatactgcaaatataaaccagggatggggtgtaggaattgtaaaaacaggtatgatctgattattgtaattcataacattaggagagagataacggactaatattgcttcaacagataaaccaaagaaagaaggagtgccataacatatactctgcacacaatgggacctacagcttattaaactgattttctttgtgctatatctgctaaatatttgttgataaatgtccacttgttggtctcccatactgtacgaatgaaacctcaatttacag

SEQ ID NO: 8442 - DNA, 210 bp, Homo sapiens
ggacgtgtacttgagaaaagaagagtaataatgaatataacttaatcaataaaaaaaacaaggtatttaaaaaaagaaaggaattaagagaaaatctgaatagatgtatgcaagtgtaagcttaataatgattagagtattatttggataactaaataataatgaatgaagcagagactgaataataaaataattaggagtagactaagg

SEQ ID NO: 8443 - DNA, 434 bp, Homo sapiens
  misc_feature (1)...(434): n = A,T,C or G
gtaccggcctgaagataaaatgaatgaaataatgaataggcatatcaaatgatatatagtaatatacgtgggagcaactagcaatgctgataaccttgaatgatgacaaaacaaaattggtaaaatagaagaataaattaccaatacaatatactagacattgttaaaccacaatggtatagtgaatgcaagaattatgagtgaaacacacagtgaatagagaagcgagatacgacatatgaaaagacagtgtaattctgatggtnggtaatggtgggtgggataagactctatgatcacatagctgacaaggcgataataaatgatcaaaaaacatatggttggagaccatgcgctggggactttttctgtaggatatgggagtggacaatctaggtcgccaccgcgctaatcactaatgtattcgcggccgc

SEQ ID NO: 8444 - DNA, 162 bp, Homo sapiens
acgtgtacttgaaaaaagaagattataaataagtataacttaattattaaaaaatacaagggattaaatgaaagagagtagaaaggaaaaattggaatagatgtagacaagattgatgttaataattgattagagtattatttgtatagaaaattataatga

SEQ ID NO: 8445 - DNA, 226 bp, Homo sapiens
gacgtgcacacctgaataaattgtatgctatactaacttgccaagattaccacaacattaaaaacatatgtatacattaatgttctggcagtggactatgagaaaaaaactgaaatgaatacagtgatgcatgtagaacatgtcatgtgcaaactggagtggatgttgaggacggagcaatgagaatctgaaaactcacagggatgaaaaaaataaacgatactta

SEQ ID NO: 8446 - DNA, 242 bp, Homo sapiens
gagtgcacaacaaaaaagaagtgtataaaaaaatattgcatgatttattaaaaataaaaaatattagaaaaaaaaaagaattaaataagaatttgataaaataaatacaagaatacttagacatatgataaaaatatgattgttctactacattctaattaagaaaggagattgagagataaataaagaattaagagtagtgaaagagtaatgagtaagagtatgaaatagggatgtaatga

SEQ ID NO: 8447 - DNA, 162 bp, Homo sapiens
  misc_feature (1)...(162): n = A,T,C or G
aagtaccaatgtgctgggaggacccaataattgatgcaggggtgtggggtgttacactgtgactaaaaaaaccacataacatcataactggaacatcactatgttgggatctgtatctacagatcacataaggaagggaagtcgtggaganaagcatggggt

SEQ ID NO: 8448 - DNA, 194 bp, Homo sapiens
caggttaaaaaaaaaaaaaaaaaaaaaaaaaaaaaaaaaaaaaaagcttgtacaagcttttttttttttttttttttttttcccagtattcataaaataaattttttagattggcctataaaaaaaaacatccaaccacctttccctaggaaccttttgaacaccataagaacaaaagctctaacatataccta

SEQ ID NO: 8449 - DNA, 513 bp, Homo sapiens
  misc_feature (1)...(513): n = A,T,C or G
gggtaccaaatacaccgacaaaagaaaaaaagcagatgggctgctaggtttctgcttttaaaaaatttcatataagaattgggtttcaagcaggaagccagaacttctgcctctggttcttaaattaacattcggtgtgtaatggacaataggcagggactcataatttgactaactcacatgctcaagcatgatcgtgtccaatttctacaggcctcctttgtaaagaaatgtgtaacaatggggggaaagtcataattctacctgaaaacatggattgtaagaagaaataaaaaaatcaaacagtatgttttaagtttcccttttgatactgtgtttcagggtaagtgacagcttctgcaaaccaagactcagtcctgattataaaggatttttaaaattacattattaaaaatatgtatttattcttctttcactttatctattttccaaagcctctttcaagtaaactgtgaagtgcctgagtacctgcccgggcgggngtggtgggtg

SEQ ID NO: 8450 - DNA, 638 bp, Homo sapiens
  misc_feature (1)...(638): n = A,T,C or G
actagaaaagcctggctgccatccatcgctgcctctgaggtggaggaagaggcgggtgatgtgctcacttctgatcaacatgtgttgcctcctctcagccaacttctatctcactgcactcactctggtcatgataaatgttcgtcacctttctgcttcattccttanggcctaaatcangaagctgttttatcgatggtttccttttgggtcagtaaccagctttggataatttcctctgattattcaagtcgtgggacaggtaaactacattcagcangaacttttctncgagagtgttatgtcatggaaaagacaccaaacacagcaagtattgtaatgaatacaccatcccaggggtcagtaagctctgcctgccaagaagacacagtgaggagggtccacagtcctgatgangtggcgtttggtaacttgtagaccctagcatggccaggtctggtcacccttaagaacttctcagagaaactaggaatcttcagtgaaagaactaatgttctcctcagctgaaattcccttgcttgtcagcatttctgcaaagctcacacttgtttcaccatacctcccttggatgtgacatgtangtangaagtatgtgcangtgggagtcatttgttagg

SEQ ID NO: 8451 - DNA, 162 bp, Homo sapiens
tacatgtcacaccaccgccatgttttgttgattgaatcggcttgggtatgcggcctccgctgactgcattggacattgatctcggggagacgtgaagaggatgtaagggtggctatgatcgctaatagcaccgagtgcctccttctgtgaggtgactgagac

SEQ ID NO: 8452 - DNA, 386 bp, Homo sapiens
gtgcatgctatcaatgtgtccaattcccacatcctgagctacgcactggaagacatgcctaagaaaatagacgaaatacaggtacttcttgatgacagacgaagcataagataacatatcatagtatagatgaagcaaatataacgactaaactaatcttacataacaatgcattacattatttgacacacatggtcatgatgtgattaagataagatagacaaatatgaagattaaatgacataatgggtgtgaaagaacgaagtgaattgatacacacactatggtaatatctgtatgatatacactaatactactgatcatacaactaaaacaaaaaacaaagaatatctagttcctgcttgtcaagcatgtgataactaatg

SEQ ID NO: 8453 - DNA, 162 bp, Homo sapiens
tgcgtcatgcttctcagtttcttctggtaactaatgaccaagatgaccaatacattgtcaacaatgccatgatataagataaggtagtagaatggattatttgatatttattttgtaaatgtgcatctttttcaactcaattttatatttctttatgatttt

SEQ ID NO: 8454 - DNA, 194 bp, Homo sapiens
ttacaacttataagaaaaagtaaagggaaacctcaacatgcatgcaactgccttgtgtgaccagtgtaagtaccccccacgagctatggaggataatttagccccggaagcgttatgcttttcattattcaactgttctccccagggtgttgcttggtcaaaattaaattatttccatccatagccaagatttg

SEQ ID NO: 8455 - DNA, 178 bp, Homo sapiens
tttgatttggttaagacttgatgatatggatggaacctcactcttaaatgcgtgatagacacacactctatgcaaactgggaagtttgacagaaagtctgggtagggaaacacacatacaggccttggtcatctggctagcagaactatcctgtgttgagacaaattgcccgtgcgct

SEQ ID NO: 8456 - DNA, 226 bp, Homo sapiens
gccgatgtacgaaggaagccaatactacatgaggtgtaataatgcatacctataactgcactcacctctatgtaattgctcacatgccgaccaaggtgacaattttcttcactgctgacacttctgagtgatgatatcaacgaatgaacacgctgccactctctgacaagacaactacgaatatcattatatataagaatagggaggggctctgcttactaaagac

SEQ ID NO: 8457 - DNA, 482 bp, Homo sapiens
gaggactgtgtaacatgtgtcactgggcaagctgtgcctataatactggtgatgctgtgagagtatgtgtttggtggacttgcagtggttgtgatttgtaagagttacttttattttttgtaacattttcttatgatcatgtctgtgttgggttgatagtgaaggatataatgacttgttggttgtattgtagatattgtgacatcagacgggatcacgctaatcacttttgtattttcgggcgggtgtaagtctagcatatgggagagctacataagcgttggattcatacgttgaactattctataatgtctgctattataggttggcgtgatgatggtcataagtggatactgtgtgaaattgttattggctcactattgtatactatataggaaccggaataattggtgtaaagattggggtgcctgatgagtgagttaaattgcattaattgcgttgtgctcactggctgctttcca

SEQ ID NO: 8458 - DNA, 226 bp, Homo sapiens
taggcatttctgacattttataaacctacatttaaggggaatttttaaaggaaatgttttttcttttttttgttttttgagggggcaaggagggaccagaaagttagctcttcttatgtggaatattatcataaaattaccttagtaaatgccatgtttataatctaatctttcaaagtattgaattgatgtctgcaatgcccatcctttcttcttaggaattgga

SEQ ID NO: 8459 - DNA, 162 bp, Homo sapiens
aggtgtcacatgtagagctagtcatattaatatacctgaatgttatgtattcatgctaattaatataatttgcaccaacaaaaacgtcaaacaacatatgtgtttgggaggtctttatgtaactctgtatataaaatacaatgcacgtttttcccgttgttt

SEQ ID NO: 8460 - DNA, 674 bp, Homo sapiens
  misc_feature (1)...(674): n = A,T,C or G
ccatgaagtctgtcttttgtcaaagttctatgcagtcccaggatagcgtgatagcagtggttaaacacaaccagctagttatagctttcattgtatggaaagacctctctggtctggaactctgcctttgaaattatccacgtagttcagaaggcaaatacttgttaaagggatcccaaaaggtaggagacaagtagtttttgttatgcattagggcagactttcaagcacaagacacaaaattgagcagcaaatgtttgggtagtcccatctcccttcggtttatatgtgggtagtaaaataaataaaattttccttctttgtctctttcttgaaataaaatatcaggtatccaaggagagctgaggattctcaatttgctagattgctttaaaggggtcagatttagaaaattaaggaataaatgaagaacaattttactggagtaggtgtggtcaatangccctttttcattttgtgccattgcttttagcacaaggatgtcaaaaatatcacatagaatgtcatctctgatggactgacagagacctcctgttgtgctgtgttaggacatgaggcttatcccagcttggcgggagagaatgctaagcatgatgagtgagatctgccacaggcacggatattttctgctcctcttctgtttgtttcaaaca

SEQ ID NO: 8461 - DNA, 338 bp, Homo sapiens
atcaccatcagggtaaatgacactcctgatgatgctgttaatagaaactgggttataacacctccccattacactcaagcacaatgtgtgtagttctctaataaggagatgaattgttcttttataccatgagagtgacatgcacggcacacacttggttaaggggtgtgcctgcatcaaaaataaaatacatagaatcagtgtaatgtgaacataaaataaagaataaatagcgtggctgtcacatgctatttccctttatggaaggtgagtgatatgtcgtgcatgctgcgttctgcacaactggcctactgggagggcactgttgctgcctggtt

SEQ ID NO: 8462 - DNA, 498 bp, Homo sapiens
gaagagcataccgatctaatagtagccagtcagggttgtccgagattgcaaatactagatctatatatcatatatctatcattatatatatgggagaatatattatgggaaatatatatcaaaaatctatatataataaagtatttagtagtaatgaatatggtgatatgaaaatatatatataatatattatgtatatatcatgatgactgatatactgagactgtcgtactctgacttatgatgcatggctatgtgagcacagggatgtgactacggggctatatatgcagggaaaataaggcagataacatgggtagtatgtctagggtagtgtgtgaatcacagaagatgaatcagtgaagagatattattgaattgatgctattcagataatgtgggtgtgaacagatgcatggcatcagaggcatgtctgatatggcatgaatgagtgaagtgaaacgtatgaagagatactgattaaagagaattcatgca

SEQ ID NO: 8463 - DNA, 290 bp, Homo sapiens
ggtaaagctatttggttcgattgttaatttagtttgctttagagagtagaacatataatgcgacaaaagattagtaatgagaaaatcagtatttcattggatgtgttaagtgtcaaaagtcactgtaatggtgttgtgttcaaccggttgtttgttttgaagaataatggtgtatgtgttacatcccattcttcatgtccaaattttggacgttccttgtctcactcagctgtgataaactggtctggagttgctgaccgaccattgttcatcgaatgaggcattatctg

SEQ ID NO: 8464 - DNA, 242 bp, Homo sapiens
ttgggtggtggaggaggtgtgggtggatggtggtgaagtgttgtgtggatatgtatggtttatagagtagatgagaatgggataaagattgtgaattatgaggatgtggagtagagtgagtataaggggtaagatgtatgaaatatataatgaatggattatgtgaggtgaaaatgatagatagggtatggtgtgaatggagaggatgtaatttataaaatgaatatggtgttttgattgta

SEQ ID NO: 8465 - DNA, 178 bp, Homo sapiens
gggccgaggtgcacatgtggaaagtaggtcatgagataaaaccatcaatatctaatatatatgaatcaagtgtgagttcacaactacaaacactaaaacacattattaaaaaagcttgtacgagcttttgctttttttttttttttgtttttcggatcacaacgcttactatacgttg

SEQ ID NO: 8466 - DNA, 402 bp, Homo sapiens
cgcgggggaggtacacttaaacactgtgagaataacagagaaagatgagggtttttatatacagtggccgctgtgtttgcggcacttgggaatgacatgtttgtttttacaccaccgtgagcgggacctggaagtagagggtgcgctgcacaaggcccaaagagaatatcattacttgctgatggtgggtcacgtgcgccgggcacacggctgtggcggagctagcgctggccgcttgccagcttcacgcatgggctccctactcctgacgcctatatgcatactgttgtgtgttgcaactgtgtctaccatacaatgctcggagggatgctgggaatgacgtggtgtggggagacatggctatgacggttgaagattgacccatctttccagggtggagcg

SEQ ID NO: 8467 - DNA, 210 bp, Homo sapiens
ttaccgatgcggccgcgccgggcgatgcacgtgatcaatcttgtactgaggccacagggttgcaccagaaattctgcttctaacacttatgtctgagtcctgtcctggagagggctgactgcacaatgattatcttttcttttacatgtggcacgtacgtgcagcatcagcaaggtggaggggggctcgcgctccacacgcccccaacaa

SEQ ID NO: 8468 - DNA, 674 bp, Homo sapiens
cggggccgacgtgcatgataaaaatttgtggaaaacatgggtcctgtatacgggggcggatcaactcctgacacgtaattcttaggatcaatatgttgggctgtgctgaggctgacaggtgatcttggggtggtccttttatggctcgtggagggtcttcatggttaggcttgcattataccatcagatcatagaagcggacacattgactcatatcctatggctagtaaataagatgtactggatagtgaatctctttggttacgcatgacgaataactggaaagaggagagtgacataaatataatgcagagccatattgtctacttgtactgcaaacttttgatgatctgtatagatgaccagagcatccaactgagtgaggagcatcatcgcggaagacatgattgtcatgtcatacgatagcagcggagcatataaagaggatattggcatgctctgcgccgagtccaggctactgactaccgtatgtgatgccgactgcaggtgcgatatgatggagagctcagctcgcgtgggatgggtaacgttcggttctatagtgtcacgtaaatagcttggcgtgatgatggtcatagctgtgttgtgtgtgagtggttatgcgctcacaaaccacacacatacgagccggagcataagtgaaaagccggggt

SEQ ID NO: 8469 - DNA, 226 bp, Homo sapiens
cgcggccgaggtaccggtgaggaaagtgcggattgacacttggatggttgtaagtatgaatcacctgatgaggtcacaaatacaatgcaatcgtcaaactatttatagcagcctctaacttgcttcatatgcttctgtttacagagtgaatacgacccatctgctgcagtgaatgtgattgagctctcaaggtctgggcaagaggggattggtgtaagtgtatcca

SEQ ID NO: 8470 - DNA, 162 bp, Homo sapiens
gggcggacgggcctgacggggaggaggtttttgggtgtgatgaagattgtggcgtgtttgcggcattggacagcctagaagctcaggacaagtgatgactctgtattggaaagtgatgacgcaaggccgggggacgcaggggcagccaacacatcagccatc

SEQ ID NO: 8471 - DNA, 226 bp, Homo sapiens
  misc_feature (1)...(226): n = A,T,C or G
nccgnctccgggtctagnttactgggacaacctgntgntggncaggnatatggcactcaccgggctgggntaaggcacagncctgggntaactcactgggcattgggcaggctatccggcatgggctatggcacagcattcctacctggccatgacctgtgcatgctaggcacagctatttgcgtggccctccgctctgctctgtgctatggccgcgcatagcgca

SEQ ID NO: 8472 - DNA, 338 bp, Homo sapiens
  misc_feature (1)...(338): n = A,T,C or G
gaaggantagcaggnaccgagaggataccagcattactgacgaacanggaccagccccacctgggaccctcttaccccacaactctcattgggctacaccactcagtcgaccgatacacactcgacacagggacgntagggatgcaatgatcagacctcctggtagtcacctaagcactatctgggactggtttggggtaggacaaaggcagcacatcttggcaactggcacaagggcctctccaagctgtaagggcagctcaacagcacctactgggatgggtcagcgcaggggctgctggtcctaggtactctggcccggggcggaacgacttact

SEQ ID NO: 8473 - DNA, 224 bp, Homo sapiens
  misc_feature (1)...(224): n = A,T,C or G
ncagntacgncctggcgnaaggntcctttctggacgntcaaggagnatgnaatctggnaaaaactgtctattctcttagnagnagnaaaatataccccacctaaagtcgcagctaccattaacaaaaaaaaaaattagcaaagggaaagaatcaatggtaaggacagtaaatatactctgagaatagagtaagtacctcggccgcgaccacgctaatcactagt

SEQ ID NO: 8474 - DNA, 770 bp, Homo sapiens
  misc_feature (1)...(770): n = A,T,C or G
gggncagntactagnaaaggnccggnctgccatccatcgctgcctcgnaggtgganaagnagcgggtgatgtgctcacttctgatcaacatgtgttgcctcctctcagccaacttctagctcactgcactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagtgttatgtcatggaaaagacaccaaacacagcaagtattttaatgaatacaccatcccagggggtcagtaagctctgcctgccaagaagacacagtgagaggggtccacagtcctgatgaggtggcgtttggtaacttgtagaccctagcatggccaggtctggtcacccttaagaacttctcagagaaactaggaatcttcagtgaaagaactaatgttctcctcagctgaaattcccttgcttgtcagcatttctgcagagctcacacttgtttcaccatacctcccttggatgtgacatgtangtangaagtatgtgcangtgggagtcatctgtcagcctgctatgtttcagagatcctgaaagtggtttgaaacaaacaggagaggagcaggaaatatccgtgcctgtggcagatctcactcatcatgcttagcattctctcccgccaagctgggata

SEQ ID NO: 8475 - DNA, 226 bp, Homo sapiens
  misc_feature (1)...(226): n = A,T,C or G
acagntacgatttacagatcacggtctcaactgattttggcatcacaatataacataatttaaagtggggtgatttattcaacagtatcttgtttcgcaaactttggagacatgtcctagactgtaccttcaaactgtattcctgatcttgctggaacatgttggttgctggcggtgctggcatgcagccatggtgcattcctggtgcctgaactgatagatgtgg

SEQ ID NO: 8476 - DNA, 338 bp, Homo sapiens
  misc_feature (1)...(338): n = A,T,C or G
gnagatacgcaagnttcttttactttcactgnaagnttctgggcgcctctggtgnttttttcctntcttttctggaaccaggggcaagcactccggtctcttggcttctgcgnacggggcagnatctgagcaatgcacttgcgactattctgctcctctcctgcacaggggtaagtatcgtctctctagggtgaaggcagatctggcatttgtcgtcttcttgggactaccagaccgcgtccctttttttctctgctgcgtttcttttctcttccttatcctcttttaatctctgtccctcatacttgcttatttcatacgatgctaggttcactcct

SEQ ID NO: 8477 - DNA, 322 bp, Homo sapiens
  misc_feature (1)...(322): n = A,T,C or G
cagctgnaagctccaagncaaancaatacagnaactcatccagtgatggctgaactgtcgtcatcagctaaaacaggtaagcgaaaaagagtcagatgctgtttcgaggtttagtatatcctagtaatggttgtcctgcctgcaatatttgaattttaaatataaatctatttattaatatttaacattatttatatggggaatatattttttgactcatcaatcaaataagtatttattatagtaatcttttgtgtaatgaatatgaatatttattaatatatggattatttattatttttatatcttgtgattgttttat

SEQ ID NO: 8478 - DNA, 498 bp, Homo sapiens
cgggtacatatatcaaaggactataatataaacatgcacctatggtattatatagcaaaaagaatctatggggaacagttacttatgcacacattaacatactccctgaattttgattaacacgatgttctcatatgcatgtgatattcatctacttatttttggctggtcatagtatctgctgcatgttatcagagtttatattatcacctcgggagatacccacctaatcactggtgtattgctggcgcggtgtgagtagatcgtctgggagagctcccatcgcgttgacatgcctcggtcgtagtattctataatgtcacatgattagctggacgttctcatggatatagatgttatcctgtgtgcatatgttattagatctcaattccactcacactactatcggtatgctataatgcgtattggatgggggagttaatgagtgtatctcactatacattaattgtgttgcgctaactgactgatttacattca

SEQ ID NO: 8479 - DNA, 530 bp, Homo sapiens
  misc_feature (1)...(530): n = A,T,C or G
gncagatactgattacaacaatgccatgctctcgcagcagactcacgattcaaggtcttacatgcccgcaacatgactcacagnaactaaaacatctacactgtctaaaataagaactcaaatgtctggatgtagagactatattgagctggaaagtcaataaatctttcactataaccaccacatggcacattaatgcatcacatatcaagcgtatatagtgcctgagaactgaagaggatctgtaaacaactttcatgtgtgtaatatgactgatgtagacacgctatgcattgaagtactatctgaacagatggattacctcttgtcctagcatcatctcgactctgtcttgattatcaactgcttcccactggaaacatatgaagccgtctatttatttatgtgtgtatatgctatatgaattgttgactgtgtggaatgcttgctattgtggctattattctgaatcttaatactataaatatggatctgatatgattctgcttgtcagtctctagtgctatgca

SEQ ID NO: 8480 - DNA, 178 bp, Homo sapiens
cggccccgcccgggcatggttacataggcaccgagactgcggagtgggactctactaagtgtgtgtgcaactacatgtgcgaacgtggttttttttttacttcgtgcttgtttgacgctatggctgggagcgcatgagcacagagccatgaccgcgtgcacgccgtattcgatggcgc

SEQ ID NO: 8481 - DNA, 210 bp, Homo sapiens
cgtagtttaatatttattgtctctcttttctgctgttgtagtaccatattatatataagtaaagagatgcgttcaagatctagatcacgttctatgaggtagaggactcccttatcttgtatattcaggcggtcaagtagctatatctgagacggtcggtctatattgtatagtctatgaagtcgtgtgatgattctcaatagctctatg

SEQ ID NO: 8482 - DNA, 546 bp, Homo sapiens
  misc_feature (1)...(546): n = A,T,C or G
tggcatatgctgtattttattgtatcgtgtaagtgctagaaatatacccaatactgaaatcttattaactttgttttctatgcggcttggggttttggttgttcatgcattattgtccactattatcatttttctttaacaagatataacattgtatggtatattgtacatatattgtatgcatccattactggtgtgtgtttactactttggctgttgtgcttaacgacacatggaactgtgcaatatcgcttttatgcacaactctcggcttatttaaccaagaatattatcgtgaaacatcgtgtactggctaataaggcatattctcgtattctttgtaatgtgatatagtgatttcagatagctttaaagtgtatgtgtgacattcgtgacaactatccaacacatacttaactgtgccaatatttgtcaatttttatatctgatgcatgcgttcctaaaaaatgagatgtctctgactaacataacaggagtgtcaatttgtggtgcgtggagtgcaatgtagtagtgtcgnactcagcg

SEQ ID NO: 8483 - DNA, 338 bp, Homo sapiens
acgaggattagaaaatcactgaagtgactgttgatgacgtaggtgaagagtgggaagtagaggaggtgtggagattattatttaagtattttatgaatgctaagtaataggaagtggttgatggtgatatttaaattttgattttgttaaatttgtagtagaatattgattaatgattattttatgtggtgatattgtgatgtgctttatgttgagcaaattggatattatttattagtttgtttttgaagtgtcttactatgtgagatgagaggtatagtattgtgttgtgtgtttgttgttcatattgttgtgtattggatttagttttctttgaa

SEQ ID NO: 8484 - DNA, 177 bp, Homo sapiens
gatgcctgtgctcactgtccacgagtgcactgaggcacaagggcatgaatggatcctataaatgactcactttgcctggctcttggcactggatgtagctgttggggcttgacaatttagaacttgaagccctcacccattatccggaatattgtgatcctgactactattccagaa

SEQ ID NO: 8485 - DNA, 306 bp, Homo sapiens
aagatgtgatgaagcagaacgatgaattaatagatggaagacatataacatgcgataaaagtgatacgtgtcactatataaagagtaaagcccatacaagtatccatgctttctaatctcaacgttgtaagtggctgggcaacctatgcgacgtcttacacaaggacacaaagacatgagcatgagctataagggggctccaggactacctctaagagggataggcctctagtaactccaggctctgctccgaatgctgagaggagacttaaatactgttactgcggcccgttacatcagaactca

SEQ ID NO: 8486 - DNA, 162 bp, Homo sapiens
tcatgaatctccaaccttaaatactgaaacactgacatatgaagctatttgatgcctgcttgaatcaatatatcaccactacttgcggcactgatgacactatgcaaagttgcgtgatacgtccgaaacaatgccgtagggggggctacagggcacgaaaca

SEQ ID NO: 8487 - DNA, 162 bp, Homo sapiens
  misc_feature (1)...(162): n = A,T,C or G
tttttttttgntggtttaaaattttaataaaggggggncaaaggntgnaatggntcnaaaantcctcaagntccgnacggnactccccgnagaccaagncanttgnantccattcattattcgntctggnatcttagncaaagccccggncccctggnanca

SEQ ID NO: 8488 - DNA, 194 bp, Homo sapiens
  misc_feature (1)...(194): n = A,T,C or G
tttttttttttttttttttttttttttctaattactaccttttattctaagggaaaccagggcccgaaagncgaataacaagctggncgaaacaaaggaaactaggggtggncaaaaagaattaggggggaaaaacatggnctcttcctgggggagggagncggggaaaaggnaaaagaggtgctcagccggca

SEQ ID NO: 8489 - DNA, 210 bp, Homo sapiens
  misc_feature (1)...(210): n = A,T,C or G
tttttttttttttttttttttttatttaaaaaaatttcaataaaacggccgggcgggctcggggcggcccctatcggctcagccgggggnccctcctcccccaccccattctaccaggggagattctgggggggaggccaagttcccttctagagggggcttcacccttttcccagaaacgttccagtttcaggagnaggnagcaggcag

SEQ ID NO: 8490 - DNA, 226 bp, Homo sapiens
  misc_feature (1)...(226): n = A,T,C or G
ttttttttttttccacggntacaaaatctttaggtaantataaaataaataatagnaatattaattaataacaacaacacaacagggncaacaatattaataataacaaaanctctcccatggncccacgnccttcctccancttttctcttcggcttcacacaacttgngnanatanctgttttcatancgggnaaaacggagncccananagntcgncacactg

SEQ ID NO: 8491 - DNA, 338 bp, Homo sapiens
ccaggccaggacacacagacaccacgcacacgggaagcacggacgtgcagaccgcacctccccctctctggacccactctccccagctcgccagctcaagccaggagcacacagcgcgaccccagcccaccaccaagaggacaggacaccgagatgtggaggcggccaccgggcagacaaccgaggcgacaaaccacagaaccggctccacacgtagaagacagcacacaaacgcagccgatcccacaacagcacgcagtaccctccagccgagccacacaagctccacccgcccccccagctccacctgccgcggccccccaagactgccagccacc

SEQ ID NO: 8492 - DNA, 594 bp, Homo sapiens
  misc_feature (1)...(594): n = A,T,C or G
caactctgaatatactaaaagctgttgaattacacactttaaataagtgaattttacggtaagcaaattatatcttaagacattaaaaataataacaaaggacggaactcacacatcttctttagacagaaatgtagtctcactgcagcaagtatggcttaaacctgcttctgaaccgtgcacagttgtaggcctgtctcaagtgttccgtcgttgacttgtgtcccgcctcgccgggcaatgatgtatgtgtggagcgcagtcatgttctttgttacgcaacacagttttcaccttgggctaagatgatgtgattcttccaaggtttgtggcagaaatcccatttaatanactggtccagatttcttcatgccgtaaaattgtttaaggaagttatttattctgccaagctctcgtcatggtgtccgacactcccttctgtctcctggagggccaggcttccgtgctctggggctcagcaggacggggaggacgtatncctagacacctgcatcagtcaaggtcatggatattgggaagacagacagcagcagacccaggtctgagcttacaaggtagccactgagtctgggg

SEQ ID NO: 8493 - DNA, 434 bp, Homo sapiens
ccatttgctcactggggctacagacgcttttctacctgcaatgtagatagactggatgccactcgtccttataattgttaactttttactgttatctttaacttgtgtttaacctcactttcatacactttagaagcaactggaatgataatggttattgtgaacaaggggcaaatctgcatgtgtgcagaatataatcgagttatctttcttttactgatactgaccccacatgtgtttgacctttctatgcacactgttgcctttagaatactaactgataaatcattttactgttgcttttctctcacatgttagcttaacgctgaacggcattttgactacagtgtgttctgcatatagaacattgattacacatgatatattggtttatactttttgttgtctcttgcttatttagtttgctgctcacg

SEQ ID NO: 8494 - DNA, 386 bp, Homo sapiens
gtactctctattacatcacccatgctaatattgatgatgtatcatctctatgtaggaatcgacttgtatcacctgcattactgagtgacgcatatgagatgagatgactgctgacctgttcttgtggcaccctggacccactaaagaacgcccttagtgatgaccaactgccacatgttacacattcttgatggttggctgtgtggcggaccttctcttgtgaccatgatccagaagctcctccaacactgcttcactggaacactgctgcctcagacgataccacgtgatgaagttgtggcttatggggcagctgcacgtccgagatttttgacagctcacaactctgagaatgcatagcttgagttgcctatggaggcagctaa

SEQ ID NO: 8495 - DNA, 642 bp, Homo sapiens
ggttcaagaacctgctggtttctggatgcgtaagtcacacagcctctgctgtgtgacactattcttgcttctgcctgtcatctgtgatcatatgccaggctcgtgccagaatccctttcttatactgatgtggcgtgatggatccgcatggggctgctctcctggaccttcgtgctgtccttatacctggtttggggagcacggtgtggatgacgtgagcgtgtgatgaactgcatggagattctgcggcaatagtgacacatgtggctggtgtgcttgagatatgggatgagatatgacatgcggaactaatagcatatgctttgtcatcacgatggcaaaatcactgagagaacagagaaaaaaacatagtactgtgtcgtgatcaatctaatccatgccgtatacgtggtcgacggacaggctacaatatggatcagcacactatgagtctgatgatacggtagagcatgcaatgatgatgacgtgatgggactcggcgtagtcatggctatagctgtttcctgtgcgcagttgccttccgctcacaattatacaaaacatacgagcaggaggcataaagagtaaagcctggggtgcctaaggagtgagctaactgacattattatgggttgtgcctgc

SEQ ID NO: 8496 - DNA, 530 bp, Homo sapiens
attggtggtagctcatacatagatacttggtcatatctgactcactgcttggacttctgctatatcactgcataacatggcggtgggtggttggtgtgatgtatctcattataggagttgtgtgaaactcattacgaatggaatggatatcctgatagtaacaacatataccatcacagaccgcttattgaaagcagtactatatattaccaaacttggccttgttgtctgggatgatctggacgacatgtgggtgatagaattggttgagaacatggacaagatattcaacgtgacatataacatgataccataacaaccctacaggaacatagctttcgactgatacaggtgtgactctgactggctaggatgctctgacacactgtacgtctacatacaaccaggtgattctagtttacacaataatggactgagatgatactaactgtggatgatagcactgtatgattaaaatgatctcttaggatatttaaaatagaagatataataaaaatatataaaagctt

SEQ ID NO: 8497 - DNA, 162 bp, Homo sapiens
tcgacgtatactatgatcttcttatctgtctttcgtgtattaggtagtaaccttatgtatatgtctctgctagtcattactgctctttatacattgatatagtctgtcgctggcagggatgtaaggggctctaatgggcatgtatctagctgatgctctgac

SEQ ID NO: 8498 - DNA, 162 bp, Homo sapiens
ccaaaagactgctggagaccactcaaggcaagacatgaatgtcaagtttctcaatagcaactaaaaagaaaacgaggactgactctcgaaacagctgactaatcattcggtatactgacttgaatgcccaacgcaaagcaatacatgaaaccacccaagcga

SEQ ID NO: 8499 - DNA, 354 bp, Homo sapiens
agtctgactattaaatgaatggaaatgacacccaacatatacagtatttatatgagattctgactgtctacatggatatcatgcgcggctgggtaaaaaatatccgtggatttgcacacctgcacaaagcacaccaagaactgctttttgaatcatctctcttataactggttgcacttccatgatcatacacgtggctagcgagtggtaggttaactcatatattgcaatggggtggtcttactcatgttgtggtgcataactggattagaggaatggacctgatgaatctgttgattatggcgcaacttgccaaacatgaatcttgactggtacacgactctgatgaagtgc

SEQ ID NO: 8500 - DNA, 466 bp, Homo sapiens
ggtacacatagggcactgaacatcttacttctcgtgaggattactgagctcgctgcatgtgattcgtgtgctcacactccactgtttaatatgttactatgacacacctactaaaagtatgacagctcctcttgacctggaagtgtgcaattaccatcacacgtggataatgcaaggcgctgctctcatttcctgttacttatgactgtgacgtgaagtgagattatgcactattaacaaatcatgatggtggagatgaaagtgctcatcattacatacaatgtgattgatacacagatgtgtgacggattgctgggataaaaatatatgtaagattaggactcctaaccgctggtttactcaatcataaacagaacaatgatcaaaacagaggtcacaatactgcctgaggtggctggcatctctacgacgcacgagtgcactgtacaccatgcctgcaaacgga

SEQ ID NO: 8501 - DNA, 178 bp, Homo sapiens
  misc_feature (1)...(178): n = A,T,C or G
ccngggtacatcccattgatgtcacttcgcaagagtgggcatgaccatattgtgaatctatgagtacggactattgaggactaaactggaaggatgcaactacacacactgtgaggaatggctgcgtctcacactagtatgctttattacagggactggacactggatagaanataca

SEQ ID NO: 8502 - DNA, 602 bp, Homo sapiens
  misc_feature (1)...(602): n = A,T,C or G
nactandgcgaggtacaggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttgaaatctggaccagtttattaaatgggatttctgccacaaaccttggaagaatcacatcatcttagcccaagggtgaaaactgtgttgcgtaacaaagaacatgactgcgctccacacatacatcattgcccggcgaggcgggacacaagtcaacgacggaacacttgagacaggcctacaactgtgcacggttcagaagcangtttaagccatacttgctgcagtgagactacatttctgtctaaagaagatgtgagtcctaagcagacttaaagccaagaaaataagaagaggaaagagagaggcctgccctaacccactgttgtgctgacttggacaattccaagtccaagaggactgtctactttcgaccttgtgtgattataacct

SEQ ID NO: 8503 - DNA, 178 bp, Homo sapiens
aggtaaatatcattgatgtgagtttcatactacagcatggatgtggtagtgctgcagactggtgctgcttatggggcagatacactagctctgatgtcaatgactggaacagtgtgattggatgcctgatggatgatttcttagacatgctaaagtgtaagtcagaccctgactcagt

SEQ ID NO: 8504 - DNA, 258 bp, Homo sapiens
ggggcaggtaacacctccagacctctttctgtctgagtgtatctagtttgctgcttttatttatgtattatgttctcctcatgtacttgctccttgctgctgggagaattctgtcgttctctttggccgatctcaaatcgtagaaccctaaactacttcctgcagtaactgccctggcttggcgtctcacaaggcaatactctcctcgttccagcgaggaccagagggtagcccagcctcccagtgtagctggactcc

SEQ ID NO: 8505 - DNA, 210 bp, Homo sapiens
aggtactggacctaacctaatgtagcacatggggacacatcgatattacaacaaagtctattagacgaccacgaaatacataagcacatataatgctgattgtaaatagatatccaaagcacctctgctacaaactacctggctcgtgtctgctgtatcttgccatccacatgatagggcatgtaacacgaactccagagcaatctcctc

SEQ ID NO: 8506 - DNA, 321 bp, Homo sapiens
gtacttgtgtgtctacagtcacggttgactatcccactatgtttactataaatgaggctctgtgattcactgcatggcagcaggtgatggcattgacataggccactgcttgatatgattttgtgcatcctgtccagaggtcctggactttatgagaggtatgtttaggcatttggttgacatgctatctgtctacccgtgtccttacgtctgggatcacatattccttctgtgggtacaaattgtgtgtgatttctgatgatagggggtggtgtataactatttatcttaacactggttgtatatattacattggtttaa

SEQ ID NO: 8507 - DNA, 298 bp, Homo sapiens
  misc_feature (1)...(298): n = A,T,C or G
nactandgcgggcaggtacactcangaatgtgctgcacaaactctattcagttagcagtgatcaccccgtgacccacacacaccttcgatataatcctacaaagtcttaacattaattaacataattaaataagtatttgcatctataaaaaatatacagaagaactaattgtggagtaatctgtgcctccatttcaatgtctgcttgtttcactgacattatcaatatattcttttcatacaaagtcttataaaaagcgaaggagggctgagcggatacgaccagccacacacaaaa

SEQ ID NO: 8508 - DNA, 371 bp, Homo sapiens
  misc_feature (1)...(371): n = A,T,C or G
cagntacaancttttttttttttttttttttttttttggtttggaacctttaataaaaataaaaaaggaatgcaaaaagaacacaatgttgaaaacttaatattaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcacacctcggccgcgaccacgctaatcactagt

SEQ ID NO: 8509 - DNA, 194 bp, Homo sapiens
  misc_feature (1)...(194): n = A,T,C or G
ttactaatttacttagcaaactttatcctgagatttgcaaatttaaaaaaatgaagaatcaaactatattttcttttctgtttttttgaaacagagtctccactctgtcatccaggctggagtacctgcccgggcggggtgttgtngtggttatgaatttgtgtgggtgtgaagtagagattagagataggatg

SEQ ID NO: 8510 - DNA, 162 bp, Homo sapiens
tttctgtgtaataagagtgactgcttataaggagcgtggattgcgatagagtattgtgaataaggttgtttctacttaagtagatttgtgtataggcaagagtgatgtatctttgttatagtttaggtgtatgtagttattgataatagtgcagcgttttta

SEQ ID NO: 8511 - DNA, 274 bp, Homo sapiens
  misc_feature (1)...(274): n = A,T,C or G
agcaaaacccacccaagcaacaactggggccaagaacggggnaacccaaataggcattaccccagaggaaccgaattaaggaaaatggaattaagggggtggcccaggattttgacgaccaatttgatgatgaaggaccccttccttgccttagggactggcaaacttttttaccatttggaaggtaaaattgaaggaccaatttcggtagtggaaggaaaacattggtttgtattaaaggaaaacaaaggcaatggttgacccgctttcgggg

SEQ ID NO: 8512 - DNA, 162 bp, Homo sapiens
cttgatgattgtactgtatgtgtccgtagagctgatggctgctgtgttctatggacgttggtggacgactgtctgtagatgaggaggagatgaacagtgtggggcaggtttggaacatcttgatgaatctttgcacgctcatgtattgaaatcttagcatca

SEQ ID NO: 8513 - DNA, 338 bp, Homo sapiens
tgtataatggccctggaccatcttccatgctggataggacttataagtgtgtaatacacacgtactatgggcaagatggataaagactactgcctacataacttgtatctatatccatcacatcaaccaatgataagtacgaatctatcctaattttacaaacatggacacataacaacaaagatgtcaatgtcctcattcaacagaactgaagatagatcaaacgctaaaccagactctgtctctattccctcctgttgtgccacggtgcatctctgccgagacggtgcctttatttagttacaaaacacacttgatgtatggcctacgcgtttaac

SEQ ID NO: 8514 - DNA, 322 bp, Homo sapiens
  misc_feature (1)...(322): n = A,T,C or G
ctggtccaacagctgagggatgttgagggaatactgtactgccactcaccgaattaacgcctgcaactatcagagatgaacaacataaaaaaaaacaagaagagaaaaaaacatagttagagaacctctgcatgaatcatgataagcacatatagaagaaaaaagatataaacgtggtagcgtcaatccgagagacgacatcgccatgcggtattgccagcaaacacatatggactggacagcnagacatggatcataatgatgaatgatcatgcgctactagactactgatcaatgggtggacatagcagcanacactcac

SEQ ID NO: 8515 - DNA, 786 bp, Homo sapiens
  misc_feature (1)...(786): n = A,T,C or G
ttttttttttttttttttttttttttttagtttaaagactatttcagttttagtcagactacttcagacctcagactccagacttcagactccagactttagacaacagactccacatgccacacaacagactttcagactccagcttcagactccagactccagatcgcacacttcagacaacagactctagacaacacactccagtctccacattccacacgacagactacagactccacactccagacaacagactccacactccagacaagagactccacaatccagacaagagactccacactccagacaagagactccacactccagacaacaggagacttttagactccagatcagacttcgaacttcagattcactccagacttcagactccagaccagacttcagactccagacccagatttcagattttagacttcagactccagaccagatttcatatttcagactccagaccagacttctgacttcagacttcagactcctgacccctggcaacatgcacatggcangcccttcacttagctggtagaaggaacacaggcttgggaaggagatgtctgatgttcactccctgacgacactcttacttgcttcaatgatctctctgagccttgggtggcccatctgctaaacaaggatgagttatttgctggggatgctaggagacttctgcctcatgcctgcagtgctgctcatgttgcccccttggaattacttgttcaacttctttctttcccactagacggggactttttt

SEQ ID NO: 8516 - DNA, 338 bp, Homo sapiens
cgagtactcttagtagcgcacgtctttgttgtatgcctttgatgggggctgctgaacgtctttttcaaggatcatggatgtctcatggaggaattaaatctcatgggtattgattcattgcttcacggggctgaagaataatctgtgggtgatgtcctgattgatgctgatatgacacatctttgaggtaagaacttgtttatgtccttgaactggatgggattgttctttgtgacctcatgagtatatacatgatgattcagctgtagacatgtgtgacatctcttatggttaacatggaggtggacattatacctgatggggcgaacagctacttt

SEQ ID NO: 8517 - DNA, 274 bp, Homo sapiens
tgaggacttgatagcatgtgtgtgtggactgaaatgcttatctcttccggagatgtgacgaaacgcctggtgtgtgtttgtgtttgggctgagactgtatagagctggtagtttgtagcatgtgagagattggagtgagtctgtgtggcttaactcctttctcgttcgtctgcgcataccggcatttagtctcgtgggttgattatggaacttgcatgtgaggctggatattgatgagctgtgtgtagtgcggctgatgcttaatatagagtct

SEQ ID NO: 8518 - DNA, 610 bp, Homo sapiens
gaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggagtggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgaacatcagatgggacctttcagccaatttctataattattgaacagcttttcgtggggccagcacaaagtctttaactgctcatagtagttaagaaaagatggggatacatttc

SEQ ID NO: 8519 - DNA, 162 bp, Homo sapiens
taccaacaactcttggtaaagatcacctccgcatgcacagagtgcttgacatgtgctggatatcacgcttgtcgctatacgaagggatgtgattactgtctgtaacgacccttactcgttgtgtcaataattgactcatctagacgtggataggctgattca

SEQ ID NO: 8520 - DNA, 466 bp, Homo sapiens
  misc_feature (1)...(466): n = A,T,C or G
gtacttgataagttgattctaaaatacatatgaaagtataaaggaacaagaatagccaaaaacttttgcagaaaaacaaattangaagacttgctttaccaaatatcgagatatgtgtttataggtaattcactgagctgacattaatgtgttgtgtatttttttggtcagagttgatccttactngagagtgggtatgcatgagtgtgtgtatgtgagagtgagtgtgtgtgtgtgtgtgtaaaatggaggagaggactaaaagtgtgactagaagcagctggaagtagcanngagagtggaagttagtcccctcgagtgtttgcaaagtaagacatgcctgcccagcactcttcctagtgtatagtggctacaaatagagtagagaacagactccagtcctcaaagactttcagtcttgcgagtcaactcagactcaaatgtagaactgggaaggacagtgccg

SEQ ID NO: 8521 - DNA, 210 bp, Homo sapiens
atgcacagtgcacatatctggtacaagctaaatctggggcgcatcacagccaatggtaaattctacagtcccttctcttacggatcataatgccttgattgtaagcgctgcacatacctcagggtcgccatctactgtagataaaaaacaactgtggatgactataacgccatgtgcagtctcatggggtagaggcttcactcgtttaac

SEQ ID NO: 8522 - DNA, 514 bp, Homo sapiens
tgcacattagtacatttttcttaatggtgtaatacttgcgtgtagctgaaccaatcatggatactaccatatcataaaagaacatgactatatctccgtctatcatccattaaactattacctttcacagctaaggccttgacctatgcctgaatgatgctgttacataagctgagataatacagccatttctgtgtcatccatcaggataaacagtatccacgttctacgagctgtgtagcgtgcaaccaatgccaggagtacatactgtatgctgtggtcggagcttctgctaaccactctatcatgtggaagatggataatagcttatgggggaagccagacaagattgataaaaccactataggtgcattgacatgtctagctatgtggtgaggaatgtgactatacatcgtgtgatgatagttgggaagtatgcgctcaatataggccatctgctggtctgacagaatctcagacgtgaccacgctacgtaccagccacggccggccgg

SEQ ID NO: 8523 - DNA, 322 bp, Homo sapiens
acttgatacaggctctgacaccagatgacctgtagagtggccacagaaggtgggcaacacactaatagggtacggtggaaaaacatatggcggagagagtgacatgatgatgatttcatttaggaagatgactacaaatctatcataattgtacaatgtacgtactcctagcatatcgcgtatatgaccgtcgatcatttcaacagaaatgaaagcatggatgtcacgctacactgagcgtaatgtatcggatgcgctggctgtttgtgcgcgctgctgcagtcgtgtgcacgtagcggtgtgcgctctgacttgacgtaac

SEQ ID NO: 8524 - DNA, 210 bp, Homo sapiens
agtacttgtttggtggacctgaacctgattctctgtgacagtggcgactaaaattgtggcaccgcacttactgtgtacggaggaacaaacagactggcgtaggcactggtctgtgcatgtttgcatctataaaacagactacaactgtatcgtgattctacgtggtcctcggcctggcacactgtaatgagtgctgaattcgtaggacag

SEQ ID NO: 8525 - DNA, 178 bp, Homo sapiens
agtactggtgtgttgaatcggaaacctgatttactgtgcagatggccgagataaagaagggcacgtactaatagggcacggaggaacatagagacgagcctatggcactagtaaatgcatgtattgcatgtataaacaggactacaaccgtattctgatcctacagcggcccgacgcc

SEQ ID NO: 8526 - DNA, 306 bp, Homo sapiens
aggtacacactatgctgatggcacttagtaagtccagcgcatagacgagacagactacactagactctaaaatctgcacacacttcacgaaaattgaatggtatgtggagctgagaactgatgagagtgatcagatcacttcattgcaacagatatgccgtcagatgacgaggcacctgttcaactgctaagagccagacgtgccaacatgtctttacataaatgggcatatgatgacccacgagaaaggacactaagttacactgtgaaccgtatgtcatgaatgccgtgtagatgacgaccaag

SEQ ID NO: 8527 - DNA, 626 bp, Homo sapiens
  misc_feature (1)...(626): n = A,T,C or G
tgcaccataatccctgacgtagatgaaatgccagtgtcaggagaatgcagacatactcaatgacaacatanattataagatgaccactgaagtcttggaggctgaccatgatgtgcaatgatgagaatgataaaataaataacaatgagcttgatactgttgaatagatgttgcagctagacaagcaaaaatattgagaaagctcaagaaattcaatagaaaatgtgggacgagttagatctatggcattccacactaaatgtagctggattctgaaggttcagacattgttgaacaggagccaggacacgctcacgactggatggataacttgatgattgctttccagcagtatcagcaggtatcacagagagcagagtgtagaacctcacagttgaatagagccacagttaagatggaagaatatagagaccttctgaagagcactgtagcttggatagaanataccagtcatttgctggccaatgctgctgactatgactctttggagacactgagtcaccatgctagcactgtgcagatggctttagaagattcagaacagaagcacaatctgttacattgaatctttatggatctagaagaccgtgaatagtttatgaaac

SEQ ID NO: 8528 - DNA, 690 bp, Homo sapiens
  misc_feature (1)...(690): n = A,T,C or G
gcggcgcggaggtgannnaccatagtgccctggcanaagattgaaatgcgccaggtggnaaggaatgtcagaaaagctttataagacatagatgagaagattancaatgaagtcttaaaaagctcaccatcatatgcaatgangtagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcangacattgttgaacaggacccaggacaggctcaagantggatggataacttgatgattcctttccagcagtatcagcaagtatcacagagagcagagtgtagaacctcacagttgaataaggccacagttaagaatggagaatatagtgaccttctgaagagcacntgagcttggatagaaaataccagtcatttgctggccaatcctgctgactatgactcttttgagacactgagtcaccatgctagcactgtgcagatggctttggaagattcagaacagaagcacaatctgttacattcaatctttatggatctagaagacctgtcaataatttttgaaacagatgaattaacccaatccatacaagaagtaagtaatcaagt

SEQ ID NO: 8529 - DNA, 562 bp, Homo sapiens
  misc_feature (1)...(562): n = A,T,C or G
gtacaccatagtccctgcagacattgagatcccaggtggaggactgcanaagagctatatacaacatacatgataaggagatcagtgaagtcttgggaagctcaccatcatatgcaatgatgagaaaaatagaagaaggtaacaatgggcttcataatgttgaaaagatgttgcagcaggagaagcaaaaatattgagaaagctcaacacattcaaaagaagatgtgggacgagtcagatctatggcattccaaactaaatgagctggattctgaagttcgagacattgttgaacaggacccaggacaggctcaagaatggaggataacgtgatgattcctttgcagcagtatcagcgagtatcacagagagcagagtgtagaacctcacagttgaatagagccacagtgaagatggaggaatatagtgaccttctgaagagcactggagcttggatagaaaataccagtcattggctggcgaatgctgctgactatggagtcttggaggacactggagtcaccatgctaacactgtgcagatggcttgggaagatcagagc

SEQ ID NO: 8530 - DNA, 194 bp, Homo sapiens
tacactgtggaagctgcaggagtggtgaccgcactcggtggactgtctaaggactactgaatcattatctagacaacacaaccagtgagtctgtgagacggaagcactataagcactgatgtagtaatgataaaggaaggtaacatatgcagcttcatgaatgctgtaagaagatgtagcgacaagaaggaaga

SEQ ID NO: 8531 - DNA, 194 bp, Homo sapiens
actgtgggtgctgagtagtggactggacccgatggcctgttaagcccatctgtatcagtcgaacaacacagccatgtagttgtagcaggttgaactgacagaatggctggtgtcgcgcagggcagtacataacctgaatcgcttatgcatgtgttgcctagacacagagaagcaattcaataaagtatgacccc

SEQ ID NO: 8532 - DNA, 402 bp, Homo sapiens
  misc_feature (1)...(402): n = A,T,C or G
acacggtgggaggctgagtaggggtgacgaacctgcattgactgtatataccatctgtcacattatatccaacacaagaatatacactatagcaggttgaaattatacaatggatgttgtatctcagatctgcacataacttgcacaactaattgatgcttatataaatacataaagaataaatangacaataagtcacacttgaatatacgttatgtgatgatgagagcactgagagtgcgtccagatgtcctcagaacatcactgagcaggaatgaggtggctaatactctatccactcagacataacagacaaacgaggcacacgtgaacagngaccgaggatcctgactagcagactagggttgccagattcaacagaaaaaaatccaggattgacac

SEQ ID NO: 8533 - DNA, 178 bp, Homo sapiens
gctcaattgatacataggtaaatatacataacccagattgctactaatagaccaaaacatcgacatatgcctattgtcacgtatatatactactggcatagtgtatatctattgaaagttgatgggatggcacttcttgtcggataactgacacaaaagtgagggactcatagcaata

SEQ ID NO: 8534 - DNA, 178 bp, Homo sapiens
agtgccactgagcacagaggacacatacctgaccgatatgtgactaagatctcaacctacgacctgtggtcattgtaacggtatctagatgtggataagcgaccatcacactagactgtcgtgctatggtcccgctggtagggacctctcacctggggagtgccgactaagcttcctc

SEQ ID NO: 8535 - DNA, 450 bp, Homo sapiens
gagtactactgaaatcaagaatacatgtctgtcggataggtgacagagtaactctacgcagaacgtgagcacgttggaacggatgcagatatgtacataagagaacatcaccaaagagctcgtggcccatcagcgcacgtagaagactaacatactagtgaacgaaagcccataatgcacctcctcaatggttaggcctgtagcacacactcgcttgagaccctgacccgctaatgctacagacccgagaccaccggcaccctgtacctcggtcgtctccacgctaatcactactgaatacacggacgccggctagtctacgatatgggcatagctctcaacggcgctggcagcatgagctgagtattgtatagtgtgatcgaaatagctaggcgtatgcatggacatagctgataactgtgtgaatacagtatacggttgaaggtacct

SEQ ID NO: 8536 - DNA, 161 bp, Homo sapiens
gtgccacggtgccggaggacacatgcctggcggatatgtggactcagatctcaagcgagaacctgggccaggcgctacggatgtagatggacataagagaccatacacacagacttcgttccacgtccacgctggtgggaaacaatcatactggggaacga

SEQ ID NO: 8537 - DNA, 226 bp, Homo sapiens
atgtgctgccgatgtcataagtgcatggctgttgggatggccgcagaagtggctcgaacagacagtttataagccggtacagttaggtggagcacataaacaaaaaacacacaggagttctttccacatcatgacctcggtgaactgaatcattgtgcttactatggcttatgtctacacccactcgagtatgaccatacagaaccatactcagcagacagacgaa

SEQ ID NO: 8538 - DNA, 370 bp, Homo sapiens
  misc_feature (1)...(370): n = A,T,C or G
ccgacgtgtgcgtaaagacgggtgtcagtacagactgtgatgaaggctgttggagagactggctggaagcgtatatgacgttgtacaagacgtgatacacatagataatatatacacgctgctaactgtgacacatcatgataatgtactgtacccgtggtgttgtgctctagcttgcttttgcacgcacatngagtacgtaacatagatcctgaacatggactgaccagatccatagtagaatctgaacttgtacatctcggcgcatacagtgcatatatacacatgatgctgagccancacacaaggtgctgggagctgtggactagacctactggcagctgctgactcaggaacggagcatgagtgc

SEQ ID NO: 8539 - DNA, 162 bp, Homo sapiens
atatcggtagtagcagtgcaccgcgaataggtgttagctcaagaacgctctgacatgctacgcactatacctgaacagcgccggggaggatgaggggctcatgggcaagatcagcgtggaggactagaagaaagttctggacaagtgatatgaagttttata

SEQ ID NO: 8540 - DNA, 178 bp, Homo sapiens
actatgagatatggacacagacggtgtgagtgtgtgtgtggggaatgcgaaagcgggttgctgcttggtgcgttaggtgataaggcaaactagctgaagtgtttatcgtttgacattacagtgttgtttgttagaagtgtgatagctcataggtggtgactaatattgttttattgag

SEQ ID NO: 8541 - DNA, 194 bp, Homo sapiens
  misc_feature (1)...(194): n = A,T,C or G
taaactagacccaaaccacgacactcctcatcacgcaccccaccaggtaacagccttaacgctgcatacaaagtggtaaagcgaagggcacgcaacctcatataaagagacctgtgtgatcctcactacccagcgactgccggataacacaatcaacacctacaccatcacggcaangactacacgcacagcca

SEQ ID NO: 8542 - DNA, 226 bp, Homo sapiens
  misc_feature (1)...(226): n = A,T,C or G
actacatgatgcacanaaatactcgcactaaaacaacacacataatcaccactattgtgttctatgacatacatgtgttacacatgatcatactaatgttaataaggcaatgtaggtaaacactgcgcatacgaaatgccacctaaaacgtgcaagaaagaaggacagtggggaggagcaaggacacaataagcagctcttgaaaggaaccaatgaagcacctata

SEQ ID NO: 8543 - DNA, 178 bp, Homo sapiens
tcaggcggatctaaatagattagttaagaaaaaagatatgggtgtgatagtccgcagtgagatgtggtgggggagtgtggcttgcgtggagaatgggtggttttgaagactgagtgggtatggggcgggggagggagaggcgtgggtggctgtgggggtatggggggcggggtgacgc

SEQ ID NO: 8544 - DNA, 210 bp, Homo sapiens
gtggttattgttgcagtatcggcatgttaagatgaaactattctgccatcttactattattgtatgtgttttcatacattggagttgggggatggtttatgttggattacttaaagtaaataatacttaaaatccaaaaaaaaaaaaaaaaaaaacaaaaaagcttgtacctgcccgggcggctgctcgatactgatggtgtagtgtggg

SEQ ID NO: 8545 - DNA, 610 bp, Homo sapiens
  misc_feature (1)...(610): n = A,T,C or G
caggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttggcagaataaataacttctttaaacaattttacggcatgaagaaatctggaccagtttattaaatgggatttctgccacaaaccttggaagaatcacatcatcttanncccaagtgaaaactgtgttgcgtaacaaagaacatgactgcgctccacacatacatcattgcccggcgaggcgggacacaagtcaacgacggaacacttgagacaggcctacaactgtgcacgggtcagaagcaagtttaagccatacttgctgcagtgagactacatttctgtctatagaagatacctgacttgatctgtttttcagctccagttcccagatgtgcgtgttgtggtccccaagtatcaccttccaatttctgggagcagtgctctggccggatccttgccgcgcggataaaaact

SEQ ID NO: 8546 - DNA, 311 bp, Homo sapiens
cacatctgtagactacgtgttgcgtggagaaggtgtctgccatgtacgctgtgtacttctacggcttcaacttgatttagcgccgtggatgatgaggggctcaggggaagaatgaatgaagattgatgaaacattgtgttggtcaagtgtggagcatgggtgtcgtggctggacgcaactttgttggctgacaatgtgcagtttaagcacaacaagaaagagctgaagcacgtgtgtaacaccatcatcagctgactgttgctgagatgtagagcggctgtacctcggccgcgaccacgctaatcactagt

SEQ ID NO: 8547 - DNA, 306 bp, Homo sapiens
caagcttttttttttttttttttttttttttttttttggaattttaaagtttttttattttgaattaaccaatttaaaaaatgggctggggttaagggttttaaaaaaaaaaaatagtggtaaaagggcggtttaatttattttttgcttgtaaaaacgggaaaaaaagcaggttaagtccttgccggggggggggttggaaataattatggaatttgggggggtttggagggggagcttagggggaagttccaaaggggtgggttgaaaagttggagttttttttggggttgtttaaaaagttgg

SEQ ID NO: 8548 - DNA, 194 bp, Homo sapiens
cactctgatggtgctattattgtggcagtctctttcctttatttgaacttatctttgaagaaaagaatatggcagatgctgacatagcatatgaacattaagttgaggagtctttattagctaaatagctcaaaatacaggtggtgaatgttgagctgcctattgatggcatataggaatgagagatacgtgaa

SEQ ID NO: 8549 - DNA, 226 bp, Homo sapiens
agttggcaaaagttcactctggggaattttgtgtgtgtgtgtgtgtgtgtgtgtgtgtgtgtgtgtgtgtgtgttttgggaaggggtggttgaggaagaagagtgctaggctggtgttttcttactccaaaatggaaatactgcccttgattcattctcacacgttatgtgaaaatacatcatagcagtcttggaaaagatctacgtcttggttctgtttagattt

SEQ ID NO: 8550 - DNA, 178 bp, Homo sapiens
tgtcgtttgtggggtggtttgtgtgttttggttgtcttcctgattctggtctggtttttctctttttggtgtttttctattgtcgatgtggtggtgttgcttgtttctggttccgttggtgttgggttctccttcgtggtgttggttgtgtgctgtgttactgtttttctctctgctg

SEQ ID NO: 8551 - DNA, 546 bp, Homo sapiens
caggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttgaaatctggaccagtttattaaatgggatttctgccacaaaccttggaagaatcacatcatcttagcccaaggtgaaaactgtgttgcgtaacaaagaacatgactgcgctccacacatacatcattgcccggcgaggcgggacacaagtcaacgacggaacacttgagacaggcctacaactgtgcacggttcagaagcaggtttaagccatacttgctgcagtgagactacatttctgtctaaagaagatgtgtgagttccgtcctttgttattatttttaatgtcttaagatttatttgcttaccgtaatattgacttatttaaagtgtgtaaatcaaccaccttta

SEQ ID NO: 8552 - DNA, 258 bp, Homo sapiens
tatatgcggagatggactctactctgctttttcctataggacttcatgtgtgtgtgtgtatgtgttaaagatgtgttgttggtttccataagggaattctggaaatcaaatgtggtatgtttatgtgtacttgtaatcaggttgtcagtcccttgctgatatggctttgttttgtgtagatacgaaggaatcttaatcttcggggtgggatgaagagagaattatctatattctttgaacgcgttgttttaagaatca

SEQ ID NO: 8553 - DNA, 626 bp, Homo sapiens
atttaaaattagtcccctttatgcattttactctacatgtgttatccttgcaaagaaaaagactgacatctttgagagcaagagtttttgtcttattcacctctgtataatttccaacatcgtgctttgcacattggacattcaaaaaatgttatacaagattgactgcatcaatactggagtgttgtgtgagggttaggtgctgaggctgagaagtgtatgagggagacctgagattaaacctgccacataaagtggagagaagtagcaaggtcagggctatgaaataatcccaaaaactttagaatttctacataatacagttgacactactattctcaatagagctgctttcagtctcaaagggctgtggtatgtgtgcgtgtgtgtgtggtaaaaaagggaagcagcaggggaaggaagagaagtgtgatttcacaagacttaagtaatcttgtcattgctgctttttctgccagaaaattattaccttccctttaaaaatcattttcatatacattttactaacttccatgtcaatttcacccttttttttctaataatagctactatttattcgggaccaactagtatacttaggactatgctgggtgctggagtgccaa

SEQ ID NO: 8554 - DNA, 402 bp, Homo sapiens
agacacggggtgactgaggaggaagttagacggaggacagggaacgaaggggaggcaaacaagtcacgtgagatatggaccaattgcttaaagatgctacaacacatgtggaaaagtctctagcatgatggcagggagtggggcgatgtatggatactgattgcaatgcgcactgagtcataatctgggcaaaccatgaggccgacatctatatccgaagagcggaaactacagggaggatgtgttcggtgctgactatgtgaatgatctaattccaccagagctgcaagccatggaccatggtcatgcagaggaagatgcctaccacacgctaaggataaagccagatgacctgatatgtgacatgggagtctaagatgtctgctccttgttctacatatc

SEQ ID NO: 8555 - DNA, 290 bp, Homo sapiens
gtacaagctcttacttctattgatcctgtatgatctttcacggttctttcttgggcctcaaaaagagacacttattaatagaaaaaaaatgacaaggatgtccatcctttggctcccttccctcccccctcctgctgctccctaacccccactatattgagccatggctggggctgggtggcaggacagcccaaaacatgagggcaacaacattgaggggcataacactaatggaggtgtagcataagggcccaatggctcgattagacctctggtctctcacagatatt

SEQ ID NO: 8556 - DNA, 658 bp, Homo sapiens
  misc_feature (1)...(658): n = A,T,C or G
cagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggatctctgtcgaagtttgccttacctgggaaatcagaagtgacatcttccttcaacgcgagtaatacaaatatcttccagaactatgcaatggaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctgnaagatactttctaaagtcaagcccatcaacagaaaatatgcactttccatcctccatttcaagtcagacggagcagtcttgcatttcaacatcagcctctggtcttgacacatctgctctctctgttcaagggaattttgatctaaatagcaaatctaaactgcaggaaaatttttgcacccgaagtattcagatccctgctaatagatcaaaaacagct

SEQ ID NO: 8557 - DNA, 546 bp, Homo sapiens
acacgtgcagcatgtcagctcagagcaaacgtaggggcctgcggccaagatcagtgtccattttggccattacatatgacttcataaagtgactttgttggtctgtgatgccagctctctgaaatgtgcacactaacataaactgggatggaatacggttcgtgtgacagactctggaacaggctctgtggtaccagcatatatggaggagcaaaggaccggagctgagaatgagccattggcgatatgaagaagagctgggtggtgcactcgggcatagatcgccaggcttgtatattgcacgtgtcgcatgctctaggcacgttccactgccaagtgtgactaggaaaatgaccacaccgatgtatataatgatgaggaatatggagcttgcgagcctactgtggacatggctgtggagatgatgggtgagtactgtatcgaggccaagcacagatagtctgggacatggtaatgaacgagtcggtcacgatacagatgcagatgttatgcagcatgtcagctgtactactatgagacgacgga

SEQ ID NO: 8558 - DNA, 450 bp, Homo sapiens
tgaatttggataatatgtgactgaaacacgagtggcaataaaaaagcaaacatgaactctggggtttaatagatcattacatcagtatcatagaccatgtgactgtggggcttataacttgtgtagcctaatgaagtgccaaaaaagagaattatgattcaaggggagcggatgaacaccactattacagttacagtttatgctgtatatggattacatcaaacaaacaaagaacttgcttgcgaatatattatatatgctctgtgaataacggatatgtatgtagtagactgtactcatgctaatccaaaatgctcagcgatatatacacgaatgcgactggacaaactgattccttcagttactgatggaagggcggcacgatcttctgaatatattgcatacctgacatactgacgggaagaggaagtgatgagaagcctataaaaa

SEQ ID NO: 8559 - DNA, 274 bp, Homo sapiens
cacatggggattatattttgtattggcaaaatgagaccacagctggcctgccatcagatcaacataaaaaccagtattatggtatatgagatgaatggatagaggtggggtttattccttattatagagaaacaaatgtatgtcttcatcagtcttattagggacatgaatagacgaatgtacaagtggcttgcctacgagcctgtgcgcttggcctacgagatcaatagggggagacagaaggaataaacgatggggtctggacaactgaggt

SEQ ID NO: 8560 - DNA, 178 bp, Homo sapiens
acggggggaggcctttcgtgcgagttttgcttcacaaggaaattagctggaaaaggcttcttaaagaaacacaagggaaaaggaaatagggcacaaggtattattgaaattcttttaaagagcagtaggagcttgaaagtttagaacctccattatgaattccaaccacggaaaagcc

SEQ ID NO: 8561 - DNA, 194 bp, Homo sapiens
gggtacacaagttcatacagacatctgtcatattctgagcagcacatatgagagaagctttgtgttctccttgctctcttgcatgtttgttttgagcttgtggctccacagagactctcatggatttatgacaaaattggcatgcgaatgatttttgaatcataacttgtctattattatgctgtagtgtggta

SEQ ID NO: 8562 - DNA, 322 bp, Homo sapiens
actactgtagtactggaatttttattgttttaaatgggtagaaaaatggtaatataataatatatgatatataaactttaaatgaaaaaaaatgatgtattgtagatatttgatgtagttttattttttaaattaatcataaatcagactttgattgtattgtagtgatatatgactttgaatatattataaatgggaaatgttgattttttaataatagacttatatgtagggtgttgttgcggttatgttgtgtgagtgaagtgtttggttttatttagtgtggtggggtttatttaaagaaaaagaaggtagtattagg

SEQ ID NO: 8563 - DNA, 354 bp, Homo sapiens
gtgctactgggaacataatgggtcaggtggctatctaacacgaatgatcaatgtgactacatctgaacatggtgttcagtgtgtgagactcacacagagctttaccagggtgtgaagatctgctgtgtgtgcgagcttcttctattaattaggaggactctgtgatggactgacctggatggcatatatatgggtcgattgcctcagcagatgagtatctgcagataaagcgacgttatgaggtaggtgaagatcaagacaacaacataccttatttgggacgactgagtatacacagttaatgagcataaacgaaatgttatatatgatgagtgagctgatggcgagaaacag

SEQ ID NO: 8564 - DNA, 226 bp, Homo sapiens
gttttttttttttttttttttttttccagctcaacccttctttaatgtcatccagggagggggccagggatggaggggaggggtggaggagcgagaggcagtgattggggggtgggattgaccacttgtgccatgaagaggggagactgggtatttgggtcaatcatataaaaagacaagggggtgggcgaactggacctggggggggataggacggggcatgggc

SEQ ID NO: 8565 - DNA, 370 bp, Homo sapiens
acagaggacgggaacaacaaagagtctgtgaacacacatgcaaaaaaactccataatcttatgtacgcagactgaataatgatctgctgggatgggaaaatgacgcaagaacacggatgtcacgaaacataccgtataaacgaggtggtgaatgaatgtaaagaaaagctgtacgtagtcctgcagaggatgtaacatgaagatcaagcagctgataagctggcagatgacatcacacaatacataacagcctgcaacaattatatcagatagagagacagaacattatgatgaggaacaatgaaatgatagtgatacagacaacgatgtagagaccatagcttgaaatgatggaagaaagtgaagtgaa

SEQ ID NO: 8566 - DNA, 226 bp, Homo sapiens
caactaggaaatatcggagaatgagactcagaagtatgctatgggatgctaccttgaagtcagaataacgctgtgtttaccatggaataaacgttaaattactgttgctttttggataagtatgtattacggcatgctgcacgataacaccttgtcgatttaaatttgattttttgttttcgtccatctaatgcattacatgctcatctcgaaagacttaaaatat

SEQ ID NO: 8567 - DNA, 194 bp, Homo sapiens
  misc_feature (1)...(194): n = A,T,C or G
acggatgatgaaatgatgacatcatctacgagtgcatgcttgtaaaggacagcttagaacagtcctatatgaacaatcacacctatcatgactggataaangaggcctagcgttgggactgatacacacacaacaacacagtgaagatgtttattngagtgtatttattctgatgccataggtaatgtagtttt

SEQ ID NO: 8568 - DNA, 578 bp, Homo sapiens
ggtacaatacgtgcatcatgactgtcattagaaacttggggctatgtggccaagttcactgttcattttggtttttccattttcattcagaaagtccctttgttggtctgtggagaaatatatatggaagtgtcacagtaacatacactgtgatgtaatgtgttttatgtactgtttttgagacaggctctgtgacagtgatcatatgatggaggagcataggacgagagcagagaaagagtcaagataaagccgaacaagaccggaaatccggaattgtgcacagatagataaggctaccctagtcagtgacgcaggatacagaagtgcttgatctactgtgcttaggtgttttatttatatttagatgaaaaaaatgataaccaccatctaaagtcacagagatgctgtgaagagatgtggaagcaatgtgagtgttttgataataacataaaggactgaaaggggggaaatagtagcctataaagtagttaaggatgcatatgaacataaaaaaacagagcaagaaaccggaaaaaaagaaaaagaaggagggaacgaagagcaaaaaaaagaga

SEQ ID NO: 8569 - DNA, 226 bp, Homo sapiens
aaaaaaaaaaaaaagctagaacaagtcctatttgttttttttctttttttgtaatgtgtccaatttattcaagatactccaaatcaaaaacagggcacaacaccaagcccgcggcccaacacgcgacggacaagctgaaaatgttttttaagcaagtggtgggtatttttgttgaggcgcgacgaagagagaacaaaaaaccacacaaaacaaacaacgaaaaaga

SEQ ID NO: 8570 - DNA, 194 bp, Homo sapiens
acagtcacagatgaaacaacatttgtaaggaccatttatgtaaactgctgagatgttatgttttcattttggttttcacagacacattcaagctctgtccgacatgccattaaagcactggctcagaccgcacgcatattttcattttttaagtaactggtaagtattttttttctcacaaacgcacaccggta

SEQ ID NO: 8571 - DNA, 274 bp, Homo sapiens
cagggactcgggctaagatcatgtgaatccagtggatgtgggtcagatatggacagtgtgtgactagttgcattaatctatgactgaatgctgagacacacctggcggtactagaaggaatgaacccacaaaggaacgcaccagcaatgtgttcatgacacatatgatgttttttagtatatcatacacacgcgagaatcatcactcgcagacttagcggcagagaactatagagacgacgactgtcagcgagcagccgaaggtggcactccaa

SEQ ID NO: 8572 - DNA, 274 bp, Homo sapiens
gtacaagcttttttttttttttttttttttttttttttttttttttttttttttttattttaaatcaattaaagatttatgaaatttattggggtacagggaataaccgggacaaaagggggagaaaagttggtaaaacaagtgtattttaaatattctatacaattttttttgtgtacatatttggaagtgatgggtatttaaaaaaaccgcatagaaatccacaaccttaaatattctgcaaaacaaaacattaggttctctcttccttaat

SEQ ID NO: 8573 - DNA, 162 bp, Homo sapiens
gttagggggaaaattattaatgattaatttttattttggtgtgtattggtatttgtgtttcttattgtatatattgtggaaggtgttgggagtgaagtttttgatttagagatttgtgtgagttttattattataatgattgatagttggtagaataaagta

SEQ ID NO: 8574 - DNA, 274 bp, Homo sapiens
aaggcttttttttttttttttttttttttttttgggtgggaactcatttttttattcttatatattatatattggatatctttacgaatgggatactttccatttggggtcagtgacaggtggtaaaaaaatttggaaacatcaggtctgaaatagtctgagatggtatggacttataaggggcaactggcacattcaaggactgtatgaaatggcattaaaggactgggttacaatggaggggtatctctaaaccgggagtaactggaacgca

SEQ ID NO: 8575 - DNA, 354 bp, Homo sapiens
ggtattgattatggaaaaaatgaatctgtttaggggttttttcccttaaaggaagggaaggaatttttttttatgggaaaaaacaatagttaaaaaaataaattgttttttgggaataaataacacgttaaatggaatggtataaaatatagatattttgttaaaaaagtttacctttgggtataataacaaaaaggggaatgggttttttttgtaatgaaggccggggtttatgtggaagcaaccaatattaagggggttgggctgtcgatttagctttgggttaaaaaaaatggttttggggctgttaattgttatttttaggggggaaaggggggtagaaagttgttttaa

SEQ ID NO: 8576 - DNA, 434 bp, Homo sapiens
gcacgattaggaatttatgcctattatcatagggatcgacatggtcctcttctctctcacctgtgatgctactgatatcttttgtcatctttctgattgtgggatgaggaaagtcttcatgtttttatgatatctctaatcttgtacacctcggaggaggtgtgttttcatctggggcacttgtaatggtggagctttgctcgatatgccatttttgcactggataagatagtaagcatatttggcaactggggggcaactggatagcataaattaaatcttaaatgctggttgtgccatctatggaagtaaacataatgaccaggggataatgcctaggctgggtgagtatatcggccctgaaatataggcttgtatgggcatattcttggactaattgccacaagacgaaggataaagagaaaatagaacag

SEQ ID NO: 8577 - DNA, 242 bp, Homo sapiens
ctatgttttgttgattatgttgtattagttagaatggtattgttttgtttttggttgttgttaagtgtggtgttgtgtggtgttgtgatggagttgttttggtagaagtggtgtgtgagttgatcgatttagtaggggatgtttgataatgggttaaatttatgtatgttagggtaatatgaatgatttaaatgattttgtgtgaaggagagattttatgaatgaaaaaagaaaggtaaaat

SEQ ID NO: 8578 - DNA, 450 bp, Homo sapiens
ctcggaggtgttggcttggttgatgcttcgccaggtgaggcgattggtgtgtgcgtgtcacatactttttataatcacaattcacatccagtgttgagcttgcggcgttgctgtggatgaacatgccacacactgtccgacaggtggagagatattgtgaaagtgtggggattggtgagtgagtggttttgtgtgatgaatctggcgatgtactttgcggtcggatgagtggtgtctgaatgagtgcgtgaaggctctgacatatttgacaggagtggtgcgttttgtggttagtgtcaccgtacgtgatactgatatgtgatagtggaggagatgattgtgtatattgagaggatggtgcaagagtgaagtgaaagagagaaaaagttgggagggagtggagagattagaggaagatgaaaaggggatgtggtgtgtgtgtatgtgagc

SEQ ID NO: 8579 - DNA, 290 bp, Homo sapiens
caggtacaagcttttttttttttttttttttttttttttttttttttttaatttaaatgaaataaagaatatgaaaattttttgggttcaggggataaagtggaaaaaatggtggaaaggagtggttaaaaaaggataaataaaatataataaatattaaggttgggtaaaaatttggtaaggaggggtatttaaaaaaaatggaaaaaaattcaatacttaaaaatttggaaataaaacaaattagtttttttttatataaaaaagggggggggaatgtggtggggtta

SEQ ID NO: 8580 - DNA, 402 bp, Homo sapiens
aagcttttttttttttttttttttttttttttggtttaaaggtttttttttgaaaaaaaaaaaaaataaatggggttttcatgtttttggaaaaagaaaaaaaaaagggaagggggacattcccattgggggaaatttttctttgggttaaattattttaattatgggaatgaaaacttatatcaataacaagggacattaaaaaaatattaattaaaaaaaagggaagggaatggggggagggagtctggggttgggagggaaggggtttatgggaaaacattcggggttaaggggactttcctggaaaatttctgggtttggggagattaagttaatttcagggtattcaaatttctcgggcggggggccgatgcaccctaatgattcgacccactagcc

SEQ ID NO: 8581 - DNA, 226 bp, Homo sapiens
gtgtttttggatataatgaaaccttttaagggggttttacgcttaaaggatggaatagaatcttttttatggcaaaaggataatgatctaagatataatttgtgtggtgtgtttaaatcacgatttccaatggaatgtgattaatatctatctgtgctcacgtagtcttctctgtggggtcatagggataagtgcgattgggtctcgtttgtagctaacgagaggg

SEQ ID NO: 8582 - DNA, 338 bp, Homo sapiens
gcacggaggatcattgttctctcttctttctctgcaggcttgacaagtccatcttatatctttggtatatcagcatccgcacgttcatgctggctaaagaagctatcttggatgattacattacatatgttagtcttattgtggggatactgttttgcggatgatggttgtttgaaagctgcgatttgatgtaccaagttttgattttctgccttttaaatattttgttttttttttctgttatgttgtagggtgatttgttggtggttgagtctttctttaccattattgtaacccttgtttatttttgggatattttatgtattgtatttaatttt

SEQ ID NO: 8583 - DNA, 466 bp, Homo sapiens
  misc_feature (1)...(466): n = A,T,C or G
cccaagactctcatgattgttcgacctttggggctatttgtatttatgacatcattcaaatacctgctttttgaaacactaatgcctacctgccctgggtggtaacaatgttgtaagggttgctcatttgagtgaatgtattttatatttttttcatcttggtactagttttttgttatttctttcgtaatattctacttgggtttgatgtatggctactatctcttatgttttcactcatgtacttangggctttttaggttttagttgttaatgtgtgtggtattttgttctctatattgttcatagatattttatttactgattgtagtgttgttaaatttagatgatttcatgatgaactcattaaccaggaaatggacgtgcgtaatacgtatattttttgtttttgactgtgtgttctttaataagttcttgaattttctattgcgagtgttagatggag

SEQ ID NO: 8584 - DNA, 210 bp, Homo sapiens
gttgtgtttgtggaaatgtgaccttttttgggggtttttgcttctaggggagtggatggttatgttgtttatggaatgagaatttttatgtaaaaaatattttgttttgtgtgtattaaaagggttattagatgatgtgttcttattttatatttatgttaagggatggtatttttgggttttatttacaagagagtgttgggtgtttgt

SEQ ID NO: 8585 - DNA, 338 bp, Homo sapiens
  misc_feature (1)...(338): n = A,T,C or G
ctggccttcaaaaagtcgtagtggctattttttttggacaaaagtaagaaatgttgttttaggagtaacacagttcaaaagagctttaaagaagcatgcacacttatcacaaacaactctntcaggtggccagtctgatcttggatataattcattatctaaagatgaagttagaagaggggatacatctactgaagacattcaagaagaaaaagataaaaaagggagtgattgtagttccttgtcagagagtgagagtacctcgggggaagaagcatgcatgtctgtgctgatcccagtgaatcctgggtccaggagtacctgcggtatttattttt

SEQ ID NO: 8586 - DNA, 210 bp, Homo sapiens
gggttagtgaacttgtgacttttgcatcctaatgtatgctaaaaaatttttacttccaacaccatgatattatgagcgactgttttgtgcttgctaatgatgctacctgggctgtgatctacacagactgtaagtctcattggggacaaactgctccaaggaactgttgtgattgtaacgctgctatcgggatgaaacctggcgcttcag

SEQ ID NO: 8587 - DNA, 466 bp, Homo sapiens
tgattatggaatcgtgaatatatacaagggttttttcccgtataggaattgaatgcactatttctgatgtgggacacatgctctttgatataatacattgatgtatgtgattgaattatgtgtctcattgatgatgatatacatactttgatatacatgtaatgtcttctttatagtgtgatgtatgatagtgcaattggtcaccatttgtggctgaggctaggggtagtttggaggattccaatcttgatatatttagagtatgcatcatacttttggttgaaattattcttgtcttgtgatatatcagatattagctcaagggacttgttatcaatgtttttgtcgaatgactttgatgatgttgctatgctggcacatctctcagaagatgtcaagggcacattctcagattgctccacatcctatgcattctattgaaattctctggctgcgtctcatcaca

SEQ ID NO: 8588 - DNA, 178 bp, Homo sapiens
gggtagatcagctgcgcccatcatctccgactgcatgcttgacaagtcacatacttacaacacacgtatatcaccaaccgcaccttgatgctggctacaagagctaaatagggagataacaacacaccgtacggacactggggacatatcgtaacacaggagtcataatggagagaaa

SEQ ID NO: 8589 - DNA, 530 bp, Homo sapiens
gtacaagcttttttttttttttttttttttttttttttataaaacaacgcaataccaacgaaatatgagacaaaacaataaaaaccaaagaaagaagatggggatagtagaaaaaaccaggttgcttgcaaaaaagacacatattaccttaggtccccccaaagataatgatggactttgaaaaaaaccaaaataaaatacggaaaataaatattaaataaataaaaacataaaacctactgttataaataacataaaggagagtttaacttggatgagatgcttaataaaattaaagtatgatgcgataagaataaagaactattaattggacaagtccagagaggcacaaattactatgaacactaaaccctccatgatgggcaagaggaaccggcaaccccagcggggaggtttatggtctggggggacgtccgattccaggggagaaaaaccagagcttgtaaacgttattgagacttctactggagagacgcacaatatatttcacaccaatctgttgtgggagg

SEQ ID NO: 8590 - DNA, 386 bp, Homo sapiens
  misc_feature (1)...(386): n = A,T,C or G
taccggttggggtcccaagtgacagtgtaattccagggggaggtggagcggctctcgatgttacgtgacatggaaacgcgctggttttcattgatgatgccaatgtcaagcttcatactacctcctggcacaggcgggcaactctcangcttttggaaaaaagtatgtcctactttggggattttccgagctgccgcctcactcagaaaggcaagccccaatatcgacagcagcaagtacttgaccatggctgggccatgcagggtcttcactgtcatgttgcgctggtggcttactttgtgcaggaagctctttctgtgaatgtatcttcctgaccctgccgggcggaagataaaacaaaaacgagaagaacaagcaagacaaga

SEQ ID NO: 8591 - DNA, 162 bp, Homo sapiens
tattaaaaaacctaattcttcacccaatttttttaatctgccaggaacacccaataatatttttaaatatatcactttaatagacttttcttttagatgtcttttcttgtaaaggaagaggtgatatgttttcatattgatgtgcttaattcaagttgatta

SEQ ID NO: 8592 - DNA, 386 bp, Homo sapiens
tttttttttttttttttttttttttttttttttttttttttttttttttttttttttttttttttttttttttaaaaccaaaatattttttggaggattatttgggggtttttttaaaatgaatggggtggtggaacagggggcctttggggtttgggggggggtcttttgggggttccatgcctgaattggggggattaaatttttagggggcctattcgaccagttggggggggtttttgttttttaaccgtgggccttccaattttactttttttggggcttggggggggagcccaatttggcacagggggatttttggaggggggggggcttaaagccacaggggggggaaaaaggggggctttcattgggaccctctaaaa

SEQ ID NO: 8593 - DNA, 162 bp, Homo sapiens
caagcttctttttcttttttttttcctttttgactttatcacaaaagtccaaattatgacccatgaaaaaatagagcgaaataaccttactgatgaaagaatacatggacctctgcatagatcacaaggacatggggggagaagggcgcgcccacgccgcct

SEQ ID NO: 8594 - DNA, 194 bp, Homo sapiens
  misc_feature (1)...(194): n = A,T,C or G
gaccgtcctaagtaatcacaccgtacactgcacacaaacatgggcaaccagcagctgctcctgcatgctttaagtgtaggaatnacatgaacatgaaatagtggacaaggagaaacaacaggccaaggaaccagctatcataggacaagacagaaatgaaaagacatgaccaacgtactggagcggcgtgatag

SEQ ID NO: 8595 - DNA, 402 bp, Homo sapiens
  misc_feature (1)...(402): n = A,T,C or G
tgcttaaccgatggctctgatgtggtcagtgaccttgaacacgaagagatgaaaatcctgagggaagttcttanaaaatcnaaaagagaatatgaccaggaagaagaaagggaagagaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaanagcctgaagattcctggcttatagcatgcgagcattgaaagaccaatagcaaacttatcagtacctgcccggcgggcggntgcaggg

SEQ ID NO: 8596 - DNA, 210 bp, Homo sapiens
tttttttttttttttttttttttttttttggtttttttaagtttttaaactttttatttgcataataaaaaaattgtgcattccaataattaaaatcatttgaacaaaaaaaaaaaaggcactctgaataaactggattacagcctggcaggacacctgggccagcttggggctactctaaaatccactggcggcccaccccacctcccc

SEQ ID NO: 8597 - DNA, 210 bp, Homo sapiens
  misc_feature (1)...(210): n = A,T,C or G
cccacactgtcaaatgtcaactccaccagcatctganaacaatgagtagtatgatgaaatgtagaaagaaggaaggtggtaggtaaaggagcggaatgaacgagtggggaaaggaggaaggagaganagagaaagaggaagagaaaggaagaagaaaaagacagcatggcccggcctagacacaaaaccaggaggtgatcaagctcagca

SEQ ID NO: 8598 - DNA, 210 bp, Homo sapiens
cgctgattgaaacaccactatattttctggatttaaaaaaaccttctactacccctcaaaatgaagaaattcgatgagttgttatactaataagatagcggcctatgactgaaaatgctgtccgccaaaatggacgactggtcaaaaatgacacactgtatggacaatcaacaacacacaccacccccgaaagcaacgccggcaggaccg

SEQ ID NO: 8599 - DNA, 290 bp, Homo sapiens
gaggtcgagtcctgctgggcttggcaacgagggactcggactcggcagcgacccagaccacacagacactgggtcaaggagtaagcagaggataaacaactggaaggagagcaagcacaaagccatgatggctacagcgtgtgctggtggaaaccaagataaagatgcccattttgcaccaccaagcaagcagaggctgttgtgttgtccaaaatcaaaactgcacatcaacagagcagagatctcaaagattatgcaagaatgtgaggaagaaagtttgtgggaaaaag

SEQ ID NO: 8600 - DNA, 258 bp, Homo sapiens
cgggctcggaggccgcttcacgttcacctcccacacgcccggtgaccatcaaatctgtctgcactccaattctaccaggatggctctctttgctggtggcaaactgggtgtgcatctcgacatccaagttgggggagcatgccaacaactaccctgagattgctgcaaaagataagctgacggagctacagctccgcgcccggcagttgcttgatcaagtggaacaaattcagaaagagcaagattaacaaaggtatt

SEQ ID NO: 8601 - DNA, 338 bp, Homo sapiens
aagctttttttttttttttttttttttttttttttttttttttttttttttttttttttttaaaaaaatgaaacattttttttaacagaaagagggtggggggggtggggtaaaaaagggtttttgagaaagttttaaaccgacccaggtcttgggggaaatttttggggttaggggggggggaaaaaaggcctaagctttaggagggggaatttgggggttttttgtggttttgtttaaaatagaattttttttggcttttttttggcactggtggtggggggggggggggaaaaggggggcacaggtttctgtttttgttttgtccccagatgttt

SEQ ID NO: 8602 - DNA, 162 bp, Homo sapiens
gaaggcatgatgttttgattttttttttttatttattatgctaaataagggttaaacagtgctacaagccggcaaacaaatagtacggatttcacgggagaagaagcaggaccacggcgaatagaaatgatgccgaaccaaaaagctgagaacatgttggga

SEQ ID NO: 8603 - DNA, 402 bp, Homo sapiens
tttttttttttttttttttttttttttttttttttttttttttttttttttttttttttttttttttttaaaaccaaaaaatttattggatgattaatggttgacttttttaaaatgaatgggatggtgcaacaggggccctttggggtttagggggggttccttcagggaatccatgcctgaattggggggatacaatttttaggggccttattcgaccacttcggggggtttttccttttttacccttggcactccagtttttcttttttttgggcttggcggggggcccacattggccaaagggcgatttttgaaggggggaggccttaaagccaaaggggcgggccaacgggggggttttattgggacgctttcaaaaagaagaagtttcttttgtta

SEQ ID NO: 8604 - DNA, 494 bp, Homo sapiens
tacatcttaaataagtctaataattttggttcatcttaaagtaaaaatacattgaaatgaatgagagagatctagattttaaaaaagttgaccattcattattgctggaactgaagaaaggaaggatacactggcatcacgatttgtctacataagtccagttcatctcgcgtttgttttggcaagaagaggacactacaaaactcacagtgcagtcaaaacaaaacaaaacaagaaaaaagcacaaaaatggtcggtggggaaccatataacaaaactacatctcaggcagctctttctcaaggaagattctaagattttattatgtggctaattctaaattggaaatggaacatgccggtatgtgaagcaattggtgctaggactttaccctttgctgatatgcaatgataatgtgatgagctttagtgactcttgaatcaggataatcacactctttaggtacctcggccgcgaccacgctaatcactagt

SEQ ID NO: 8605 - DNA, 178 bp, Homo sapiens
  misc_feature (1)...(178): n = A,T,C or G
ctctngagcttgtatggaggtaagagtagaaacaccattatgattgtaataaacgagtgcttgaatgatctggttatgggtggctgatatcacactatggtgtagctcatgtgagtgatgctcatgatgctagtaataccgatgtggttatggatggagactaatanggggattgatc

SEQ ID NO: 8606 - DNA, 194 bp, Homo sapiens
taaggaaagaagtaagaatgaaattgaagaaagatgattatgaaaaagaagggagaaaaagagaaaaataatttttttatgtttttatggttttatttttttttgatatttttttgattaaatttattttttatgaaaagaggtttgtgttgtttgttggatttttttttgttgtataagggattgtttgttga

SEQ ID NO: 8607 - DNA, 306 bp, Homo sapiens
gtactgtttggtaccttggattgcatgagttggtgggggccggcgggcctagccactgggcgtggaacgacaccggtaatagtgttgatggagtgtggaatagctgttacccttcactatgaccgctataacacatgctgaacgatggatcccattgcacaattgtatagtgttggaggcactactgggagcgattcttatacccaacaagcgatacaccgacataacaaatggtgggatgggtataatgatcatctgtcgctgccacatcgataaatactgaattgatagggaatatgttggttg

SEQ ID NO: 8608 - DNA, 306 bp, Homo sapiens
  misc_feature (1)...(306): n = A,T,C or G
gacgtgctccacgtggaacggtggttccatactgtcccttctgtacactatacaacgnatgtgagaagcaaaacangattatgatgagatatggccctacatggtttaccgacatatgcttatatgaaagactatgacttattctgcgttacatcacctctgttgtacaagatggtaacttgcgtataagacatgatgagattggtgtggttttatttgaatttttggttttgatttggtggttatttttatattgtatgagttgagtattatattttagtaacggcaaatgtgtcacccacattg

SEQ ID NO: 8609 - DNA, 242 bp, Homo sapiens
gggcaggtgtacgcgtcgttatctaatttttctgaatcggaggccaaaagaacaaacaagggcacgaaaataggccatgccttttttggacatttataaaaggtttttgttttattttatatagatggttgattatttatagtggtgaacagttgtataagatggttggttgttgccatgtttttgaaaatataatggatagattgtgttcatggaattggtttatattttgataatagaat

SEQ ID NO: 8610 - DNA, 226 bp, Homo sapiens
  misc_feature (1)...(226): n = A,T,C or G
ggctactgntccaaggaggtaaaaggtagcttactggttgtcctcccattcaggttanaaggagnaggtctgcggnctaggnagnntcaataaagtggattggtcttagtggggcgaaatattatgtnctttgttgtttggtatatatggnagggatggggnattattgtctaggtatgagggatggtatagtgaataggggcaaggcacgtcctccctagttttg

SEQ ID NO: 8611 - DNA, 194 bp, Homo sapiens
  misc_feature (1)...(194): n = A,T,C or G
gctgcaacggctattattcatcctagtgggntaatggagcantaggttagtattttgcgttgctgggtttggtttaatccacctcaactgcctgctatgtaggcataatattgagtatagtgaggagaaggcttacgtttcagtgtgggcatagtattgggtatatggagcgtagatggtggactgtacttgtg

SEQ ID NO: 8612 - DNA, 274 bp, Homo sapiens
ctgcaagcaggggggacgagcaacgtgagatgagcaggggatggccaggtgaagcggctggagatgttttaatgcaccgtcgcagggtgcaaatgagagagatcacaagcagcaaaacaactggatgagacgatgggaggggcaaggatgccagatgtcaagagatccatagcgctgagaggaatgtgggagggggatgctagagtcatagtaaaggggaaaccctatgctagctgtcaacagagttcacagggggtacgggataactgtcggt

SEQ ID NO: 8613 - DNA, 157 bp, Homo sapiens
  misc_feature (1)...(157): n = A,T,C or G
gntacatggncctgnttctcctatatggnaanaaaaanacatcccgcccctgnaatttcccagntcctctgnagnatttaatgggtgcctaaggagcatataatgaatgtcattgccatttacgaggtacctcggcccgaccacgctaatcactagt

SEQ ID NO: 8614 - DNA, 177 bp, Homo sapiens
ctactgttccaagaatggtaaagaggtagcttacgggtgctcctcgaattcagttaaaaagaaggggccggcggctaggaagtcaataaagggattggctttatgtgggcgaaaatattatgcctttgctgttgggcatatatggcaggatggggaatcacaccaccaccacaacct

SEQ ID NO: 8615 - DNA, 306 bp, Homo sapiens
taggggggggccccggggcgaggggccacaacaatgtaaaggcttatgctgggaggaaaagggcaaggttttgccggtgtttttttaaaaattatttttttgataggagggaagaaccggccttcgaagggaaaataaggtacctactaaaaaggggcccccttaatttaaggttaatgtgttaaagggggatgcccgcggtccctgggcggcaacaacgtaaataacaagggaactgggggccgcgggaggggggaaaataggggaaaactcccaaacagggggatgaatagttgggattttata

SEQ ID NO: 8616 - DNA, 466 bp, Homo sapiens
gatgtgattatcctaattcaagagtcactaaaactcatcacattatcattgcatatcagcaaagggtaaagtcctagcaccaattgcttcacataccagcatgttccatttccaatttagaattagccacataataaaatcttaaaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcatgatgccagggtatccttcctttcttcagttccagcaataatgaatggtcaacttttttaaaatctaaatctctctcattcatttcaatgtatttttactttaaaatgaaccaaaaaaattaaacttatttaaaaagagaactgccggg

SEQ ID NO: 8617 - DNA, 402 bp, Homo sapiens
cctgggaagaaaatttggttggtggagggaaacgggggcagctccaaaagggatgctgttgttaggggcttaaaaacatggcctgcccccgggaaactgaacaagggatagagggggagctccccaaggctcctgtgtgttttactaaaagggcaacagtctcaagtgggggctggaggggaatacactgtttttaagggttagggaaaagagggtgaggggatggaattgaaaaaatatatttatttttaaaaatattggggagggaactctctactgaccttggaaaacgggaaacaagtgggcccctggggcgaaacaaccctaataactagggaattggggggcgccgggggggcaacactaggggaaagcccccaacgcgttgggagaatatctgga

SEQ ID NO: 8618 - DNA, 338 bp, Homo sapiens
ggcacgcgggcggggtgggggcgcacacccccccttctggcgcgcgcgcggtgagggggggggggcgtgggaggatggggggatacagtatcaaatgaaaaataaatgttaaaaaatcaaaaggggcgggctccttaaacaattttggcgggccaaaatgtgagggtatggaggggagggaaaaaaaaagggggggggcatggggggcggtgggtatatggttctttacggggggggggatagggatggacgcagcgggggcgccccctacgacaaaccacccgcaccctgccctccacacatgcggggctctctaaacatggcttccttctaagaac

SEQ ID NO: 8619 - DNA, 258 bp, Homo sapiens
tctggtcaaaagtcaaaaaaatggagtttacaatgggcataaatgtaaaaagtgactcaaatgggaggaaaacctgggggggaaggaggtatgcgggtgagtaaaaacttgcaaagcaggtggttaccctttgccatggaacgctcgccttaatacacctgattaagcacacaaggctggttgaaacattaggcagggagggtttgtgtcggctgggcaggaaggggggcatcacgctggaagaggaaagcagcgact

SEQ ID NO: 8620 - DNA, 242 bp, Homo sapiens
gctggtctggacggtcaagaaaatgcgggataaactactcaactggctactacgtggaatgacactgttatcgtcatcgtacagaacgacgacatccaaacgcatattgtagagatacggaccagtgtatggaccagggggatcgaggaaacccgcttcatctaatatgacctacacttataatatgttgaatgaggatggtgagtggtctgagcggaaaaaggggacccactgataagagg

SEQ ID NO: 8621 - DNA, 226 bp, Homo sapiens
  misc_feature (1)...(226): n = A,T,C or G
angaaataagactgagggttctatctacacttgtagcggacatcaaacaactaatgagccaattcctcctgctgcaactggtctaacggatgcagcagtttatactgatcgacatgatctctaaagcccataagccgaaaaatggcatctgagatatgctgggccaggtgatgttgtgacgagatgtcagtgatcagatcatctaccttgtcataggccatgaact

SEQ ID NO: 8622 - DNA, 162 bp, Homo sapiens
aattgccaaatttgggaaaaacacttgtgtgtgggccaaaccctgtggttaaaagaggttaattaataaatttactgacggggggaggggggttaaggtattgtgggttaaaggactgttgcgtaaaatgtctattcgctgcctacggctgccacaaaagcc

SEQ ID NO: 8623 - DNA, 194 bp, Homo sapiens
tgattagagagacggggaacagagccgcctttctacttggttgggcgtgttttccctggtcttattgtttgttctggttttaagctccaaaaaaggggggggccatgttatcttcaatatgttttggttgtgggggcgggtggtctttttatgtgaccaacagatgtccagaaaactagggagggaattttatt

SEQ ID NO: 8624 - DNA, 498 bp, Homo sapiens
caccctaacagagggaaattttttttaaaaaaataaataaaataaaaacaataagcaaagaaaaatggatgtaataggggtgggtaaactaaaaagctacaaaaaatgggtccctccacggaaaaaattatggaactgtaaaaaattgtgggaagaaactatttggaatttctcgagtttagtaaaacagggaaagaataagggaaaaagtgggataaagaggatgataaatttgggtaagggtgggggaattcaagccttccaactaaataaaacctattttccataccccattatgggggggacccaggggaacgggggcccatgttctggaaaggaattcggggagcgggggggaaaaaaaagcactttttggccaaaatataggggttttggtggtttcgggcctttgaaggcggggggggacacacagaagggggctataatggcaacacccctaataaagggagggggcttcaaagggaatttaaaaaaata

SEQ ID NO: 8625 - DNA, 514 bp, Homo sapiens
aaattcttttgtgaattatcgtgaggaaaaaatattttttattaaagaaaatctttaattaaacgagggggactaaaaccaaaaaaaatttaccaaaaagttaagcaccttaatcaatgggttcaactctatttttcgggcggggggaaaaaaggggggaaaaagccggggagggttggagggggttttttaaattttaaaactaattataaaaataacttgggagggggaaaaaaaaggcttaacccgggtttttaaactaacagcacagggtttcattcaccctttttacctaccccaaaaaaaaaaaaaaaaaaaaaaaaaaaaaagttggcccctgggggggacccacgctaataacttagggattggggggcggcgggggggccgaaattgggggaaagctcccagcgggtgggaggaatagttggatttttttttagggtaacttaaatagttgggggtatttagggatatggtggttttggggggaaattgtgtaccgggctcaacc

SEQ ID NO: 8626 - DNA, 178 bp, Homo sapiens
ctgtgttggtgggggggcgaaaaaaaataaaaagaagggtcttgagtggggtggaaagagggggaaaaaaaaaaggggggggaaaaagggggaaaatagggggggggggaaaggagggggcgcgtggcttttttggtggttgcgagaaagaaaaaaaccccttttgagggacgcgccc

SEQ ID NO: 8627 - DNA, 482 bp, Homo sapiens
aaaaaatgggttaaaaaaaaaaaaaaaaaaaaaactggtgctaacattttttatatttggggttttttttttaataacattaaaaatggaaagagtttttattttaagtgcctctggggttaaaaacaacctccatctccttggttaaaaaaacgctttgggcccctggagggaaaaaaatctgtgaggggtgggaaaatcatccaacccggaaaacatccttcaacaaaccgcccaagcaaagagtatgagggggggacatcaaaattagggtggggattttaatggaaatctctctcataacctcttttctttgggtctacagtaggggtaaaaaactccaaaggggatttaaaaaaaccaaaaattatttaaagggcccctcgcccgggaccacgccattctttagggatcgcgggcccgcgggcgggcggaccatggggaagaccccccaacgcgtggggtgcattggttggttttct

SEQ ID NO: 8628 - DNA, 482 bp, Homo sapiens
tagtgcatagtttttattatattcgttttccggagtggagcgcgtgtttgttccgtttgtgttcgtctaagacgtgaagaaaagctgatggtttgtggtgtatatatgttacacactgtgtggagtagtgggcatctgctaagtgaagcccacaagcactgtatttatccctgacctgtatactaccatctgctgccctccctagccgcaccaatctactaccttataccaagtattgcggatatgatcacaggtcataccagacaatgcagtgaacaagtgaaagaaatgcatgtggtgtgaagtgtgatatataaaaagcccatgcagaataccattgatgccctgatggaagagaaaatggcagcaaaaatttcattattctcacaagcctgaaacgcgtgaattacaagggcttaaagaaatactaatgcctctaacctttcctatagctgctttttatctgaagggttccttgaatg

SEQ ID NO: 8629 - DNA, 322 bp, Homo sapiens
gttgtgacagtgaccgtgggggatattgagattgagataaccaatatcactacgggcacaacatacatttatgacgctagagcaagaggccgagaataacgtggataataaaattgacaaagacagcagaggcctcaatacccacggactcctgtcttgacccgaagtagagactgttaagtcctgatgcgtcgcctgcccttccttcattgctgccctggaatgtacctgcccggccgttcccccaaaacagcccggaactggggctggttaatgcaggtgatgaaccagtggttggtattgtgtattgttttgttttaaa

SEQ ID NO: 8630 - DNA, 338 bp, Homo sapiens
tgtgaactgggacctttagtggtgggcattcatgctgcatatttgtgtgttgtgttgacctggtggggacggaacatcgagtcctgggtcgatgatggagctgatggagggctggatgactaatgggcggcccaggccgggggggaccaaactccaacacaagacaggagcgagacgtgaggggagggagggacacacggggcggccatggacgcagacagcaccgtgggctgtgcagtctttgttggaggcggagcacaagccggtatgaggatagggataaaattaatgggtatcacttccctttttttgtttttggtatttttaaccacataaat

SEQ ID NO: 8631 - DNA, 306 bp, Homo sapiens
gtgaaaatatggtgtttaggcgttttgtggaggttggtggggtggtctatgtttttttttggatcttatgctggaaaattggtagagattgtagatgtttttgtatatgaaaagggttttggttgatggatattgttttaaagtgaggagaatggtaatgtgttttatgtgtttgatgttaattgattttatttttagtttatgtaggtgtttattatatgtatgtcataatagtttggaaaaaggcagatattatttaaaaaagggtaaatataatgatgggttaagaagattgaagatagaaaa

SEQ ID NO: 8632 - DNA, 240 bp, Homo sapiens
tacatttttcaagctgtttttctttatgtttttgaaggaccatttttaattagctctttgatacaaagtaactcagaacgtcaaaacctgtacccactaaagggaaggctgccgggaaggcaaatggaacaggaatggagcctgtctcaggaaggccagccgcaggtcctccagaaaatcaaagaagggaagaaactctgagtttgaggtacctcggccgcgaccacgctaatcactagt

SEQ ID NO: 8633 - DNA, 194 bp, Homo sapiens
gtccccctctttttttttttttttttttttttttttttttttttttttttttttttttttttttttttttttttttttttttttttaaatagatttttttttttgaattttttgaaattttgaatttaaaatgaattgtggaggggggggggagtttcaatatgttggctgtgttttgggactgggttggcggc

SEQ ID NO: 8634 - DNA, 493 bp, Homo sapiens
acatattaaataagtctaataattttggttcatcttaaagtaaaaatacattgaaatgaatgagagagatctagattttaaaaaagttgaccattcattattgctggaactgaagaaaggaaggatacactggcatcacgatttgtctacataagtccagttcatctcgcgtttgttttggcaagaagaggacactacaaaactcacagtgcagtcaaaacaaaacaaaacaagaaaaaagcacaaaaatggtcggtggggaaccatataacaaaactacatctcaggcagctctttctcaaggaagattctaagattttattatgtggctaattctaaattggaaatggaacatgctggtatgtgaagcaattggtgctaggactttaccctttgctgatatgcaatgataatgtgatgagttttagtgactcttgaattaggataatcacactctttacgtacctcggccgcgcacacgctaatcactagt

SEQ ID NO: 8635 - DNA, 546 bp, Homo sapiens
acaagcttttttttttttttttttttttttttttttttttttgggagggttttgggtttttttttggttttttaaatttcaggaattggtttttttatttaattcattaacctttttttgaaaatatttgaaaaaaaaaatttttttttaaatttttttttttggtggggaaataaaaagttggaggttaggggaaattaagttgaaaaagaaatgggaacatccacccccacctttttggaaaaaaaaaaatgaatgggggggaaaccaagggtagaaggggaacagggggtagggggggcacgggggggggctggctttccacctccttacattttggttacaggggcccaaacccatttggggggctttggaaaaaaaaatggcaaggggttttggagtaaaaaggggggggggggaaaaaattctggatttcgggccctcacaaaaaaggtggtttagggttttcaagctgggaaaaacacattaaaacccgggggacttttggggggtggaggaaaacaaaaaaagggaaaacaacctgga

SEQ ID NO: 8636 - DNA, 290 bp, Homo sapiens
gggtgtgatatcttttttttttgtatatatatgttgtggttatggattatgatatattgtttttaataatggagatagaattgcttgttggattgaaagggagtgtttatttatatttattaagaaatagtataacgatagattgttggttaggttaagattgaatatatatttataaattaatattgagtatattatttgttgtgtttatattatgaattaaataaattgatatgatttattttattatttgaagtcattatattaataagattttattaggtaaaggt

SEQ ID NO: 8637 - DNA, 274 bp, Homo sapiens
ggtactttctatgaaaagggtttggccatatagttgttgttgacgttctgggtgaaaatggaagggttttgtggtccgaataagggggggaaacgataaacagggtttcctcatgaagaagggtgtttggacccttggtcgtgtccgtttgttattgatttgggggcatttctgttccagactaaggaaacttggacaaaaaaagaaaacattagttcgtggttgcatggtggatgtaaatttgactgttttaacctgggttattgtacaaatg

SEQ ID NO: 8638 - DNA, 338 bp, Homo sapiens
gtgccggcaccacatgaaatgggggaccctccgtttgctgttcatcagttgtgcatccttatacagttctgttggtaggatagaacaatgagcagacatctgcacgaggatgacacggctcaagctacatgcatgtgtacggtgatgtgctatgggccacaaaggtaccctatgcgtacatggaactttgattacaactagggcatatttatggctgatttaatgtgataacagtccccagtagtcgcttccgaataaatgaaaagtgctctactgtggggtctggcaagaaaaaagcaaaaatcatgatattcacgctcacatgcaaagaaagtata

SEQ ID NO: 8639 - DNA, 162 bp, Homo sapiens
aaccttttgcttatgctgttttttatttgtttgtttatttctatcatttgttttatataaaaaaaggtggaaagttgaatatatacaaaactaacaagataggaaacctggcaaataatacataatggctctaataatcacataatagcaagctgtcctgag

SEQ ID NO: 8640 - DNA, 194 bp, Homo sapiens
tgcacatgaaacacaagatgagaaagtgtgaagtggagacacagaatagtaagaaggggacaactagagacaagtctgttgaacaagagaaacaacaaaacaattgctgattcatgttgcaacaatatagagggacatcactggggcgagatgccggtgtgataatgtacactagcggtggagccttggcaccg

SEQ ID NO: 8641 - DNA, 322 bp, Homo sapiens
gcacaaaatctagatttgctaggctcgaggtagagaaggacatatgttatagtagatgaaaatgatggaatagcaatgagatacaaaatgcaactaaaaatgggataatctagatattagagaggacttcaaacatgcaaataggaaccacaggtgactatgatggtatatcgatttatgtgtgtgagtattcatggtattacaggctgaatgtaacagacacaagcaaataggttgcctaagactgtgtccttgttctgtcggatgtgggcggggaggatggtcatcttctctggtgtctcactgttagactttgaagcgg

SEQ ID NO: 8642 - DNA, 178 bp, Homo sapiens
gtacaatattggtaattattttatatctgtgaagggtgtgagttaaaaaaaataattcatagaatgacaaaaagtacttaactgttgtgttagctggagtgaaaggtatgatgatatatattaactggaaacagatgaatgtccacggagctttctgttggagaggacattgcagccg

SEQ ID NO: 8643 - DNA, 466 bp, Homo sapiens
gtaccaatacgaccaattgtgtacacatcctgtataggcatgtgcatgggcttgacaatgggacgagtgggtggtaggatgcagtcaaaagcctcaagcatagtggttccaatggaattgtgcatacttaggggtgtactttccatccatatgaactattgcttgtaagcacattggcttccaagatgttgagagcatttaaaacaaagattggcacaagagatactgtgtatgagatagagagaatttttttggtgatagggatggattcatttgcaataagattatgtctataatagcagtttggcggattcaggcgaatccatgatgtaaataccgaccgtggggtcgcaccgaagctagtgtgttggatctaaaggtttgctatatgtggtgaccatcagtgtttaatgccatctacaatatggagcatctctcccttaaaccatctggaacagccacagcc

SEQ ID NO: 8644 - DNA, 258 bp, Homo sapiens
taaattaattagggaaagggttttgaggggggggggtggaagaaaggggttgggtttggtttgtttctcctcccaaaaaaaagccactaaagcagttacagaaatgaagggtaaaatgggggccacaaagccatggtatgtagctttagctcagggaaaaaaagagcgccgggctcacctcattaaccagtatatgcagagatgggcaggggtacctgccgggggcgccgggcggcgggtcgcgctggggccggggct

SEQ ID NO: 8645 - DNA, 178 bp, Homo sapiens
agtactgtttttgttttttgtttgttttttgaagcgagagatgacggtatgggggaaaaatggatgggaaaaggggaacaaaggagagggaggatgcgaggaaaagcaccatccacgcgatgagagaggctattagtgagggacagagtggggacaaaagagagcaaagggaacgtga

SEQ ID NO: 8646 - DNA, 386 bp, Homo sapiens
catttttttttttgttttttttttttttctttctattttttttttttttttttttttttttttttttgactttctttgttttttttgtgatgcttttttttttttttttttatagtaatcaaaatataaaaaaaaaaaaaaggaccggggggaaaaaatctggggaaaaactaaaaaaacgggggggaaaaacaaaaaaaaaaaaaagaaaaataaaagcgggcgagccacaaatggggggggaaaggggaaaaaaaaaaaagaaaaaaaaaaaagtaacaaagggggccccggggagggggggcagaagggaaaaaacacccatcccgggaggggagaggggggaaaaaaaaaaaaaaaaaacaccaaaaaacgcccttcgggca

SEQ ID NO: 8647 - DNA, 450 bp, Homo sapiens
caagctttttttttttttttttttttttttttttttttttttttttttttttttttttttttttttttttttttttttttttttttttttttttaaaaaacggggcattaattaaaaaaaaagggggacaaaagaagggggggggggaagtcacaccaaaactgggggtaaaagaggggggggataaactggaaaaacaaatcaaaaagggggggcaagaacaagaagggagtggggaaattataagtgggaaaaaagccaaagataaaaaaccaccacaaaagggggtccatatgggaaggattcacacatgaggggggtggatcaaggaaagggtcctatccattgaaaaatatatcattgcggccatcatatgaagcgagagcaccctgcaatgaagaatgttaaggggggggtggagagggggaataaaattgggggaatggccac

SEQ ID NO: 8648 - DNA, 394 bp, Homo sapiens
ctattttttttatttttttttttttttcaacatatatacaaaacatcatggtaaaatgtaaaaggaaaatggagtgcgactaggaataatgaataatagaagattataaataaatacgatattaatataaattaattagcggtcataatataatgattcacaacgaaactctggaacatatataatagcctcatgacattactatttaaataaacatgatctgcatccaaactatttaatgcttatttactgcattaccttcggagacagggtctagctctgtcgaccaggctggagagcaggggtgcgatcttggctctgtggaaccgacgcctcccaggcccaagcgatcctcccgcctcacacctcggccgcgaccacgctaatcactagt

SEQ ID NO: 8649 - DNA, 162 bp, Homo sapiens
agtatttttatttttttttttttttataaaaaaaaggacaccacgaaaaaggaagacggcaaaggaacccacacgtaaaacaaacacaaacggcaaaaagaaacaactccctcaaaaacgcggccggaagacaacccaggggggggggagcgaggaaaaaac

SEQ ID NO: 8650 - DNA, 482 bp, Homo sapiens
tttgtttttgttgtttgtttggtttttggggttctaaaaccgggaaggggggtattcttggttccagcaaacgtaaaaagggaagaaaaatgggtaaaagggaacaatgaagctcggagggaagttttccggggggacaaggggggcttaaaggtaaaaaaggtgtctgtaagggatgtcggtgggggaaacgtggcgggggacagaaaaaatgacccaccaagggaagcagggggcttaactgctaaggggataatccggaacaatccaggcaaaataagggcgggttatgcccttgtatggaatggccatagggttaaaatggcatgcaggtttgttgagaggaaggaaaaaatggatggccgtgcgggtaaaaagctggaagatggcccaaatcgttgagagtgtggtgatgttgccatgggggatgtggtgcggtgagagcacatgtgtgtggaaagcctctaatactacgcaacttt

SEQ ID NO: 8651 - DNA, 386 bp, Homo sapiens
gtacttgttttatttgttttggggtatttttataaaacaaaaaacaaaataaaagccttgaaaaataacggggggcaagcaaagcgggaaaaagggggaaaagcacctcccggaggggaacccccgggggcaaggcccagccaaagagacgggacagagacaagaaaccgggaaaaggaaatataaaaaaagggaaagggcgagcccacagaaacccaaaggcggcacaggggggccggggcgggagaacggggacccaggaagccaggaaaaagagggaacaaaaaaaagggagacggaggagggaaaaccagggaaccaccggcggcagcaggcgggggcgaagggggggaggcaaggggagggacagaggaactaaaaaaagg

SEQ ID NO: 8652 - DNA, 159 bp, Homo sapiens
gtacaaatttagtaatttatttgtaaattctgccagaatactttctagctgctttgtaattttttaagagtgttattttgtttttgtttttctgttctttgttgtggctcttgttttcatttttgttgtacctcggccgcgaccacgctaatcactagt

SEQ ID NO: 8653 - DNA, 274 bp, Homo sapiens
ctgatccatcacacatactgcgtggttctgatatagggtgagtttgtcgttgctgctcattgatatgcaataaggaacttaaggaggccttctgacagaagtcactggtcctgttttgtctgaatgagctgcaaaggttgacttgggtggtggcgagaactacatgacacagatgagagtgtgattatgggaaatgccctgaacagttctgagatgctatatatttggaaaggcgtgttggtttgagtgtgggaatatcaaaggacaccaccag

SEQ ID NO: 8654 - DNA, 480 bp, Homo sapiens
gtacggctcggagggccgcttcacgttcacctcccacacgcccggtgaccatcaaatctgtctgcactccaattctaccaggatggctctcttcgctggtggcaaactgcgggtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgaccctttccttttacctcatttatttggtacctcggccgcgaccacgctaatcactagt

SEQ ID NO: 8655 - DNA, 316 bp, Homo sapiens
gcaccacgagtttgagaaggagatgggagtgtgatggatgccaaacgaatattctagtgctccatcagcttgcgaggatgtacagaaccggggaactgagatactcatatccatgttgggctgtaaaaaggctgtcaaaaccataagatgcacgatggacaatatgctgtgggcctggggacacatactgaaagacggggggaggaggggaaggggagggggcgaatcgttggtagcggggggaaagtggaagacagtgagaagacctaggccgcgacgacgctaatgactagggaattagcgggcgactgggagc

SEQ ID NO: 8656 - DNA, 514 bp, Homo sapiens
gcgtgctcaagctttttctcctttctatgtttttttatgtatttatccttgccgtgtgtagcatgtgactttaaaaaaaaccaacattatccacaagggataggcacatgaagggggagatggtggttgaaaagatgttgacctagaaaataaggcctagcacacagtcactgaaagactattggatagtacagaggggacatgaaagacggaagtgtgtggagaacattgacagaccaaaagttgaagggggaaagaaaaacacaagacggccatgtcaccgaatgttgtggagtggggggggggaggcgctcgggcaacagacaggccatataacagacgatctacagagagggcacagggacagggagcacggtgaagcaggagccagggaggtggaaagcgacatggccgggaatggggagagccaaatattgtgatctacagatagtgcacctctgatggcgagagaccatgcacctgaagctctgtatgtataatggacggcccaaac

SEQ ID NO: 8657 - DNA, 194 bp, Homo sapiens
tacaagcttttttttttttttttttttttttttttggtaatggtctttttattggaaaaaaaaaaaaaaaaaataacatttacaacatgggaaggaagtaaactgtaatttctttgaacaacaatggtggtgggtggggtgaaaaccacaaccccaaaccacttcgccggctccaaatgatgggataaaaaggt

SEQ ID NO: 8658 - DNA, 162 bp, Homo sapiens
ggtactcgtgcgcccggcttcgcttttctccgcacgccgtctgacaaaccggtatggctgatatcgacatattcgataaggtgaaactgaagaaaaacagagacgcaagaaaaaaatacactggcttccaaaaaaacgaatgaacaggagaaacaagcaagc

SEQ ID NO: 8659 - DNA, 242 bp, Homo sapiens
gagtgcaaactttttgcttctattcatctacaatgtatctttccatgtaaatcccatatcttgatgctggggtcctgtgagcagcacacagccagtatcggatagggctgaaaccaaggcgttgatgatgtgcacaccatgtatcgtgtgaaggtgagagactttggtgaaatccgatatcatggtatgatcatccgtgcctccacacacacagatggatccatctggatatacaaccaccg

SEQ ID NO: 8660 - DNA, 290 bp, Homo sapiens
tcatataaaacagcaaaataaaatagtcgtgggcacaggccagtgattctgcagttagagccgtgtggactcggtcccccatctccggtgagggcgtctcctgcacacggcacccatgcttcaggtcgcacacacgtgccgtggacccaagttcacctttggaggtgtcaatccccccaagaagatgttgctaacttggagtttggggcctaggctttcatcagagtcttccccacagaaagcgaaatgggaatgggtccttaataagctacgggcctttgttcacagca

SEQ ID NO: 8661 - DNA, 162 bp, Homo sapiens
ttagaaaggcttgtttagggtttaaaagactggttgttcctgattgtttattggtcccatggtgttttctgtgttaacctgggaaaggcagccttaattacctaaaaaaagaaaaaaaaaaaaaagaaaaattatgtgtgagatttttttttaaagtgggga

SEQ ID NO: 8662 - DNA, 162 bp, Homo sapiens
gactctggggtgatgaatggggagaggagagaaagtgaatcactatatcattctatacataagaatcagtccaggtggattaacaattttaatatgatagagaaaatatatatactttagaagatataggaaaagtatgtgtagtcctctagggtggggaag

SEQ ID NO: 8663 - DNA, 258 bp, Homo sapiens
ggttttaaatttggaaatctaaaatttttttccaacaatcttttgggagggtggacctgggttttttcttttaggttttggtccctctgtttttttattttttttctttttggaattttatttttatttgtttttggttcattttttatggttatataggggggggggtgagagaaataacggagaacgtgggtgagcaagccggtgttaaaagatgggaaaagagtgtggggcaccaaaaaccttgttccctcaagt

SEQ ID NO: 8664 - DNA, 482 bp, Homo sapiens
  misc_feature (1)...(482): n = A,T,C or G
taaaattatactggtggcggtttctgtctatgtgggggatgttctccnttattaccagttacatcctcttcagagctacccgaaaacccctctcaggaaggacaccacgagtggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttaccgagatctgctcagactacatggccttcactatagggttctacagtgtcaggcggttggctacaaggagcttatcggacaatatctgggccagttgggggcagaagatcattggggagcgtgatgaagaaagggtcatgaaaacatctatcagcgtttctggtatcttgtcttcattgatt

SEQ ID NO: 8665 - DNA, 162 bp, Homo sapiens
tgaaaaggatagtggggtgtgggaagggacaaaggaaaggaatatatggtgaggttaaaatgaagaaaaagagtaaggcaaagaaagtattgagatttatattttgatggggatggttgggagggttgaggtgggaattaatttggaaagaaaaatagatgt

SEQ ID NO: 8666 - DNA, 578 bp, Homo sapiens
ataataaaaacaatgaaaataacagtatgtaaataatggtatgtaaaaatctaacaatcacgtgaaattgaagaatttggcatgtaaaatgaataatactgtcttcccccaagaagtttagcaccaaactggctctggtgctgagataaggaattccaggccaggcttacatcgcaactcagtcctcaaaagccctctcgtgcagaatgagaaggcacaagcatatatacccattttgttttcaccttccatctctctcaatcaaatcttacttctcattttaggaagtatatagtccaaaatgggcttttaattactctttgatccttccaccccaccctgcccttttctttcctagcaaggaaatgacaatgagtgtggcctatagacaagggtaattacagatacaccagtgggctgtgtcgcccaggataaggggggagagctcaaagctggtcagtgtgtgtgctcctctctccacttagctgtcattccaccctgtgcttttctacttccctcttacaaggggcaacaggggcgggggagccccacggcacgtccaaggcataggttaatga

SEQ ID NO: 8667 - DNA, 162 bp, Homo sapiens
  misc_feature (1)...(162): n = A,T,C or G
gcccagctctgggaactgaattangaaactcaaatcgaatagggaagcaaaaaaaacaaaacaaaaaaaacaaaaaaaaacaaaaaaaaaaaaccctattttaaatggaaagggagcttaaaaaaaatttttttaagggagggaagaaagggagaaaatttt

SEQ ID NO: 8668 - DNA, 162 bp, Homo sapiens
actttgtgatatctcatagggcatactggtctttcaccatttcgcccccactttttgcccatatttcccaagctccccccctacagcaccttccatgtgctcgtgccttcatccagcacctgctccccaatgtattccgtggtagcaggtgatgtaacacac

SEQ ID NO: 8669 - DNA, 210 bp, Homo sapiens
gtatagagagggagaggtttttttgttttatagtagagagggggtttcaaaggtgttaaggaggatggtttagatataatgaaatagtgatttggaatagtaggaatacataagtgatgggaattaaggggatgaggtggagaagtatgagaaggattattatttttaatagaaaaaagaaaaggaagagaaaagaggtgaggtgtgagg

SEQ ID NO: 8670 - DNA, 562 bp, Homo sapiens
gagcggccgcccttttttttttttttttttttttttttttttttttggcgtttcaccttatttatttatgtatttattgagacggagtttcccctcttgtcgcccaggctggagtgcagtggcacaatctcggctcactgccacctccgcctgacaggttcaagcgattctcctccctcagcctcccaaggagctgggattacagctgcaagatacaaaccctgtcctcacttacgtacaattcatctctgacatgaagcagtctcccggggctccgcgtctgttcgctctgggattaaattcgcgtaggcactggggaggcgggagctgccttcgcagatatttagcatatgaggatcgaaggccagtgggaaccgtgaggagacgcacaaccgtggtttgggcccaggggcctggggggattgcgagggggggtcagctgccaagaaggccaaaaatagccggacgggtggggggggaggcgggcaaggagaagaagctgggcaatggcggctggtagttctgggtgcttcctccggtcccttcaaccccacctccaccg

SEQ ID NO: 8671 - DNA, 226 bp, Homo sapiens
cggccgccctttttttttttttttttttttttttttttttttttttttttttttttttttttttttttttttttttttttttttttttttttttttaaaaaaaaaaggctttaattttttataatggattcaagccaacaaaggtgttcaaaaaaaattcaaaaaggaaaaaaggtcaaaatttaaaaataggggggaaattttcagtttgaaagggtaaaaggat

SEQ ID NO: 8672 - DNA, 226 bp, Homo sapiens
cctttttttgtttttttttttaaggatatgtttttattgctaccagagggttttatcttcagtatacatgcgttgactggcaatacctgtgttcagactgcagagggagctcaggatgcagaagtcatgttaagaaacataaggctggggagggggggggagtaagttctattagaaaatgccaatagcttaacaaacctgagggtattacattcagttataccat

SEQ ID NO: 8673 - DNA, 338 bp, Homo sapiens
agcttttttttttttttttttttttttttggattttattttaaagttttattaagaaaaaaaaaaaaattaaatggggtattcatggttttggaaaaagagaaaaaaaagggaaggggaacaatcccataagggaacattattctttgggttaaataatattaattatggaaatgaaaactaataacataacaagggaaattaaaaaaaataaattaagaaaaaggaaaagagaaggggaaaaggattctgaatatgggagaaatgtgtgttatggaaaaagattcggggttcagggtaatttcctggagaatttctggctttgaagcggttaagtca

SEQ ID NO: 8674 - DNA, 258 bp, Homo sapiens
gaaggaacagatggactcatacactccacgatgtaagctggactagtccaacttccaacgtccgtataacgccatatgtatcttattgctgtatatagtggcaaatagaatagacaacaagtgagaggtacgactaataggggagaaaaggaacacatatgtgataggtgatgagctctgacatctgatgaaataggtgacgaacttctaccatgaacaaaatgtgttgccccacttcagataggttcatcatcttag

SEQ ID NO: 8675 - DNA, 242 bp, Homo sapiens
tgattgtggagttattcaatatataaaaagggatattcgagatgacttgaatgagctgtcttattattcgtgtactgagatgaatgttcaacgcataagtagtatatgagttcatacaagtgatggctgaagtgctgtcagcagctaatatggtgagcgaaaaggagtcagatggtgtttcgaggtcgaagagcatccgagttaatggtggtcctgcgcgccagattcgaattggaaatatc

SEQ ID NO: 8676 - DNA, 418 bp, Homo sapiens
gggtcctgacgcccaggatgggagtttctgtgaaggcactttcagataaacattaatattttaatttgattcaaaaaggaaaatggaggggctataaacctgatttttttaattaatttattttaaaaagtcaccagggataataagttcggacagttacggaaatatttttaccatacaaaataaaaagataattcaaaaaatttcttatgggaattgacgtccagaatttaggtccatgttcactagctaacccacttagtagggtggggcgagcacaaactctaccttcccatttctaggcctgttcctccctccttaaggggggaataaatattaacagggtggtggtgaggtttaattgagataaagatttatctactaaaataactcagtgatactttatggttatagtcaa

SEQ ID NO: 8677 - DNA, 258 bp, Homo sapiens
gtacgggccaggctcctaatctttgggattcattggcaaataatttaagtgtggtgtattattaaatagacaaaaggtaagttgcaaggttgaaggatcacttgataagtgagactggtgatgaacattgatgcgcttaaaagtgaagatgcttacagaataaatgaagagcagctgtccttctttcctccttctagatgttcatgctgtggcatgctcagaggttcctgcatggataggagatgggagcggagtgat

SEQ ID NO: 8678 - DNA, 226 bp, Homo sapiens
ggttcgggggggaggaggtaatcccttcatatttcaatgttttctttttgcttattttttgtattctggtgtatggcgtaagtacagataatgcttcatctcgaatggtcgtttttatataatttttttttttctcttatcatcatgattcatttaacaaaatgtttcaagcttactcaggtatgctatagtgtactacagatgaatgttgggttaaatatagagg

SEQ ID NO: 8679 - DNA, 194 bp, Homo sapiens
agctttttttttttttttttttttttttttctttttaagttttctttttaaaacacacaaaattcaatttttttttccttttttttgcaacagaaaaaaagaattgaaattggacctcccccttagggaaactttttcttttggttaacttattttaattattgaaaataacacttatataaataacagggaca

SEQ ID NO: 8680 - DNA, 162 bp, Homo sapiens
cttcgttttgctttctcttcctttcttcgtacaacaccatgtatatgcaggtgaaagagatgaccaagactagtaggctgaattagaaatttatgctgactctatctaataataattatgttggtttatgtttatctctattaaatagtgcttttggggaat

SEQ ID NO: 8681 - DNA, 162 bp, Homo sapiens
gtgtacgcaggagtccctgcgttgttcagctcctgtgcttgctgtatttttgcactttctcacagacctatatcatcaaacgctcataactactgtgctattgagtggtaactttgctgatagggctgctcaattcatgtatgatggagataatgctcacgg

SEQ ID NO: 8682 - DNA, 210 bp, Homo sapiens
aaatatgaatgttaatatataaagataaagtattgggaaaaagaattataattaaatgtcacatataaaatggattgatgggaagaaatgagaaacagggtaaagtataaaatggaagtggatcaagaataaaaaaaagagaattatgaacaaaaaaggaaagaaatatatagtcgggattacaagaaagaaatgaagtcaaataaaaaa

SEQ ID NO: 8683 - DNA, 194 bp, Homo sapiens
gattatggaaattgaagttatttaggggtttttaaattaagggaagtggaggtattttttttagggaaaaagaatattaattaaaaaaatagttggtttttgtgtatttaaaaagaattaaaaaggaatggttataattaatattttatggttagaaaaggtttagtgttgggtttttataaataaagtgtgga

SEQ ID NO: 8684 - DNA, 162 bp, Homo sapiens
ataagaggataaaaaacttcgaaagtaaagacacagaaatgacgaagctgaaggctgagagtctcccttctcacttactccatgctttatttagcattccctaaacggtgaggaggcagcggctgttatggtgtgggacaaaaccagccaccgggagatgat

SEQ ID NO: 8685 - DNA, 226 bp, Homo sapiens
gtctctgttagaggatgtgactgtgtggatggactatatatagagaagatgggtgtctagagcttagtgctaagagcctatgcgcgcaagagatatctcaaattcatagttagatgaaatgcgaggaatgtgctgctatgattgacaagaggagtagaaatgatgtactcatcctcttctacacgacataatgcaaaataggatgacatagattgtgggaatggat

SEQ ID NO: 8686 - DNA, 546 bp, Homo sapiens
tattattatcgcactcgagtctaagaggctgcactcaaagcaataagctgtgtcaacggtgtccgaggagggtaatagttgatcagaggacattgaaaatgaatcttgctgcttcatggtatattaatatctgaatagtcagacaactgtaatattatggaataaacacatcgtcaaatatatcattaatatcataaggataggtacacatggaacgttatgtacctcggacgatactgactgttatcactattgtatccggagacgtgtgcgcgtcgaccatatctgagagcgcggacggtgtaggatgcatatgtagactatgctatattgtcgtctacatagttggacatattcatggtcatagctgtcttctgtgtgatattgttatctgttcactatatcactcgacatacgagtcgtaatcatagagtgctgtgtgtgaggtgtctactgagtgagctaactcacatatatggcgtggcgctctctgctggcttgcctgtcgtgactcctgatctgagccagctgcattaatgagtcgtc

SEQ ID NO: 8687 - DNA, 562 bp, Homo sapiens
tggccagattacgaagcgcaatgttgagattgagaatttgtctatagagagtacatattcgttcagcaccatgatcactctcatcaacgatgtttattgagaggatggttgtccaccttatacaggctcatggacctataataacgctttccaattctacacatacgtgtagacgaggtagtctatatactcagaacatctagcctgctctgtatctacagtgcatgagtaagtatatgtatatgtatgacatagaattccatatcgaagaggtcgtgcaagtacactggtgctgatgctgtggtgctcgaggaatatcggctgctaatacacgtatatctattgaattgtatcagatgatatgtcacatcagttgtgatcatcactgtcgtaggaatgttagatagaatattatatgtcatctctctatgactaggcttgtactcctggtgcataggatactgctgtgtgtggtagctgtccgtgcggacgctcgacatcactagagaatgcacggatagagtgtaagtcgagcagatggtagagatctgagcgcagtgag

SEQ ID NO: 8688 - DNA, 402 bp, Homo sapiens
tggggagctatggagtctggtatggtctttgagattccctgcttgagctgggaagggggtgggttctcgctaggtttaattgtactgcaacgtatcagagcaggcgccactagtcttagagagccagagcgtcatctgttgtagccactcggctcagacgtggttgtgtggaagcgactgtggatgacacacaaagtgtgcagtgttgtgttcctatgtaactttatttatggatcttgaattttgaatatatactgtacctgaccgggcggccgttcgacatgactactgaattcgctggggagtgtaggtcgactatatgtgagagttagaaacgcgttggatgaataatcgagtgtgtgatagtgatggctatataccgtggagtactcatggtagtag

SEQ ID NO: 8689 - DNA, 194 bp, Homo sapiens
aagctttttttttttttttttttttttttttttttaagtttttaaactttttatttgcatattaaaaaaatagggcattgcaataattaaaatcgtttgaacaaaaaaaaaaatgggactctgattaaactgcattacagcctggaggacaccttgggccagctgggcgttaaccaagatttcacgggccgccc

SEQ ID NO: 8690 - DNA, 194 bp, Homo sapiens
ggctgcgggacgtgatagacgattaaggtatgattgaataattatactgatatagtgtgtaagatctcttagagagagctgtgtaattattcatctatatatttttactaactaacgtgaaagaaaggatgctggatgagcttgttctgagagtatctacttgaggctgggatgatactccaagggttgatgag

SEQ ID NO: 8691 - DNA, 162 bp, Homo sapiens
gcgggccgaggatatcatgactagatttatatgtaatatttattattagggaaagttaagaaggaacagaagactagaaaagaagtaaaaactttgatgaagagaggggtgtaagaacaggatcaagacacattaatgcctaataccaacaacgagcagtgg

SEQ ID NO: 8692 - DNA, 226 bp, Homo sapiens
aaagaagatacaagctgacctgaataaaatttgtgcaggaggcgaagaaaataagggtataattatttggagaccatgggaacacgcaaacattatgcagaaatctatgttgtggataaaagtataaatgattatgatgttaaaaaaatggggattgaacataaaggacaagtgtgtgtgatgaaccacagaggaagtaaaagcttaagccatgaaattactaaaa

SEQ ID NO: 8693 - DNA, 194 bp, Homo sapiens
  misc_feature (1)...(194): n = A,T,C or G
ccgcgggccaggctactaaggtgcaagtatatgtaaattgttttgatacctttanagtgaagggagccttttgagaaaagttggtggagtgcatcgtatcataaagcgggtaggtagtacatgtaggcagtaaatattatttaaaaatgtggatagtatactgtgaagttggttggtctagaaataccagtttc

SEQ ID NO: 8694 - DNA, 242 bp, Homo sapiens
cacctgccgattgcctatgcccatgtgcctgcccttccgggggaacaaggggtcggtgggggatgacggcgatggaacggacgcacagaacgctagccgatgatcataacatcgttgatgagaaaaatgatatgcatgacaggagtagaggttggcgattgtattaggatcattgagatcaaaccacatcacccatgtgccacactgccacgactcataaagggtgttggtatgtggatggt

SEQ ID NO: 8695 - DNA, 402 bp, Homo sapiens
ccatgctatttgattttcctcatttcaactgttttgtatgaaaatcttaatacctatgtatatggtcctaactataggccgcacatttcttttataattcctgttggagagagaggggagggaaatttatgtgaatacctggtgaccttccttgactttccaggtttcctgatgtcattcattgattatgttctccttcattatttttatactaacttaaaaattgagtatttggagaaggttttatagtatttattgatgaatatatttagcatatcaaaatttttggttttaaaaactgagtaatattaaagactataagcaaacaaaatttatagaaccggtcattaagtaattgcttaaaacatggagcccattactctaacctttataaaaattaac

SEQ ID NO: 8696 - DNA, 274 bp, Homo sapiens
gagtacaagcttttttttttttttttttttttttgtattttattttaaagtattattatgaaaacacacaaaatcaaagagttatccatggatttgcaacagcagagaaacagtgacaagagagaccatcacccataagggggaacacttatccctttggcgttaacttaatataaaataattgggaaatgatcaccctaaatatcaatagacacgggcacataaaaaaaaagattaaaattaaagaaaaagggaccaggaaactggcgggaga

SEQ ID NO: 8697 - DNA, 770 bp, Homo sapiens
ggttttttttttttttttttttttttggttttgaacctttaataaaagtaaaaaatgaatgcaaaaagaacacaatgttgaaaacttagtatgaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcactcgctgctttcatctaataacttctgggttttcataaaatgctgacatcttcattggaaatttttttcatgtaactggtttcattttcagaaaatatataagggggtcattccaaagttcagaatgatcctatttttttaaaaaacaaaattcctgtaaaacaaattaactccaggaacttaaaatttactccaagacatttccctcaaaacaaagcaaaaaaccccagcaaagatcggtacatcacaaaaacaaacacaaagaccagcgctcacaggcaagttcctcttagcttccattctgctgactgggggcttccatttaaaaagaggcttttaatcaagccactttcacagaatttaaaacaaaacaaacacatgttaattgcaaaaaacaaaaaaggaaaattattagaaaaaaagaacaaaacccaaaaaacg

SEQ ID NO: 8698 - DNA, 178 bp, Homo sapiens
tagcctcagcggggaccctcagcacatgaatacttcctcattcctggccccctcccttggcccttctgcctctcttcactgccatacaattgtgtgaaggatgtagggaagtggaaggaattaaataaagaaggaaccagcggtgaaggcccccccgccccccacagactaggtcggc

SEQ ID NO: 8699 - DNA, 178 bp, Homo sapiens
aacactatgcattacatacacacaaacacacaccacagtcataaagccctaatgatgtgctgattacaggtcaatattcaggtgagcattctttattaatttatcaaatgaaaagctttttgctacctctgccattcatgaaagacagctatggaaaaaaggaacctggtaccaatat

SEQ ID NO: 8700 - DNA, 370 bp, Homo sapiens
tggctggactgcagtacagcggataaaacagggaaacgtaaaaagtaatcagatgactgttatcgagatggagagcataccagtaaaggtagcactgactgcaatatttgtaatataaatctaaagtttatatgttaatgaatatcaatatatatatggggtatatataattacactaatcagtgacagaagcacttataatagcgacttctgagtaatgaagaagagaaatgatgaatatatgtattatctatagggcctatatacggtgactgcctcactatgatcctatgggttgtgagtaattatgcaaggctgtgtgaatgcacagctgtatctgaaggggcaactacgcagtgctgcctaagca

SEQ ID NO: 8701 - DNA, 209 bp, Homo sapiens
gcccggaggatgagcatgagcataaaggaagtgtggtaggacagatcaaagggaagtacatggaatgtacgaggtttttcaattaggaatcaaaaaagaaacgaggagacttcgaaaagctgactaattattagggaactgacttggatgctgtaagcaaagctatacatgatctgatacaagagatgggcggactggcgttagcatgt

SEQ ID NO: 8702 - DNA, 322 bp, Homo sapiens
tgattacaaagctgtatgtcatgggccaactatgcaataaacctaaactagagctatgggctgtgagtggatttcacttgatgataccatgaagactgatttatgatgtgatactatccattcttctgtcggtatgaagttatgcatgacaaaatgatggagtgcttaaatgggatgtcatatggacaaagaccgtgtgaagtgaccctgatgatagcatatcatttcaggataactaatgactggcaggttgcaaggattgttgacgactgggactggacatgcgcggataggtgattgctcacggacatgctcgagaaaa

SEQ ID NO: 8703 - DNA, 578 bp, Homo sapiens
atcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactggtggcttatgcagcactggggaggagaggggggcccgg

SEQ ID NO: 8704 - DNA, 354 bp, Homo sapiens
aactggtgctgaagataatgacatcagcaaccgagactaaggcaatacgtcattgacaccaatacaatgagcctgtgtgtgatgggtctgttcgtgctagtgctcgattttggattttgatctctatcagtatcattgggcttggactctgacactgccagcggctgctgttacactgatagggagaggaatcggactggggaggtagaggacaatgacaacgagaacatcagctcctgctcacaggcggctgtggtaagcaaagaaggccacgctgtacgcactgtaccctgcgagcagggagtcctgcaggggcggcctgggcggtctactcatgaatctgaggtcgattgt

SEQ ID NO: 8705 - DNA, 226 bp, Homo sapiens
tggtattggtaataaaattttgatctctaagaagattaaaagaagtagggaagcgtgatgttagaagcgatggcgattttctggtaagcggtctatggtctgttttattataaactaggaaaagaacataacagctcacaggacccaacttattgatgaaatgaactggagtgctgacagatactagggatagaaatagatgaagaagggacggaaacaattacta

SEQ ID NO: 8706 - DNA, 498 bp, Homo sapiens
agcatacacggcagatatgcaccatgcaatgcccgagtgaagcactgcctgaggacaaagagggcttgaatgtcaggagtgtgtgatggaaggatggacggcgcggctgcgaagatgctgacagatggacagacccaccagaggaatgaggaggctgcaatggtcaagagagtatccggaacgatccagggcgaagaaacgccggctatgcatctgcattggagtggcacaggggtcacattgcatgcgagagacggtgagcgtggggagaaataagatcgccgtactggaaagatgctggaagagggccggaaaccatggaagtctggtgaggctgcaatggtagatgtggatcatggctagtccatgtgagctgagtagttaatcagactaggcacatcggggtcgcaactgctgtgcgtgatatgacacagacagttgctgtgggcgtactgaatgatgaggacaaagaagcggatggccctgataaagaaagga

SEQ ID NO: 8707 - DNA, 226 bp, Homo sapiens
tgtacacgggggtgtcttgcgcatgtccatcgggaggtagggggactgggtggtagcgcgagttatacacgatgaaggcgaactggacacgttaatgtgcttggaccccatgccgatcgcgacatacgggctagctggaggagggaaacggcgatgatggggcaggatgaaggggcaaaaataggggcgtggtgagcagaaaataactgctggccttattttatgt

SEQ ID NO: 8708 - DNA, 498 bp, Homo sapiens
ttttttttttttttttttttttttttttttgggtttgaacctttaataaaagtaaaaaatgaatggaaaaagaacacaatggtgaaaacttagtatgaatgtgaacctcactagatgttcaaatctggtagagtgcaaattttggtcatactattttacatttttacaaactcaaatcactttgggtcatatattttctataaactattggcaaaaaaatcctcaaatttacattcttttggctacattatttctaacagatatagatttacttccggtttcggagagaaagacttattgtgtgtgcgtgatcaagtctggtttaaagattcactcgctgctttcatctaataacttctggtttttcataaaatgctgacatgttcaatggaaatttttgtcaaggaactggtttcattttcagaaaatatataaagggggcaatccaaagttcagaaagatgctattgttttaaaaaacaaaaatcctgtaaaaaca

SEQ ID NO: 8709 - DNA, 162 bp, Homo sapiens
  misc_feature (1)...(162): n = A,T,C or G
cgagagatgacgttccaagacatctgagcancccgcggggctatacaaccatgtaaccaaagcctcaccccttcccgcagttggaaaaaaatttatggaacaagaaaagttatcatttgaaatttaaaagggtgggcagaacattggtcccaaggaaatatt

SEQ ID NO: 8710 - DNA, 194 bp, Homo sapiens
  misc_feature (1)...(194): n = A,T,C or G
tgaagactagataggagtggnaagactggacgtatgctctgaaggagcataggagacataagtaaaagcgggcagtaaactgtcgtctgatgattatgagaccatgggaaaaagcatgagacaggtaaaacatagtaatgggcatgttacaagccactgacgtatgcctgcactattgtacagcacctttcacc

SEQ ID NO: 8711 - DNA, 162 bp, Homo sapiens
tctttttgttttatttatgttgtattgtaagatgtcaaagagtaatacgcaaggcacaaaagatcatattgttagcttgtatggttgacagagacagtgaatattatcaaggaaacatcacatctgaaggacttagcattgcaacacacaatttataagaac

SEQ ID NO: 8712 - DNA, 210 bp, Homo sapiens
gctggtgtgttatttatttgtggtacatttagaggaaagaacggtagggagccatatatgacgaagagggtaagaaggcacatgtagtaagaagaataacaagtgacacgccacagtgggtcagtggcgcaagataacgcgagatcattaactgacatggtaacaatctggtacatatcactgtgtatacatggagagaaactgacgtga

SEQ ID NO: 8713 - DNA, 178 bp, Homo sapiens
cggttgtgctgttatttttatttttgtgtattttaagaatgcaaatatctgttaaagcgagcaatatatgatcaaagaaggcgaacgaatggtaggggcaggaggtagaatcaacaaggaccactgccacttggggatcagtggcgcaaggtaacggagctagattaacctgatatgg

SEQ ID NO: 8714 - DNA, 194 bp, Homo sapiens
ggtgggcgtttatttctttaatgttaggtttaagaggaaagtagctgggatagaaggcatgcataatacagaaggctatgaatgctatggcaagaagaagggataatacgtgcgcgtgccacatgggtgttaggggtagaagataaccgtgagcagaactgtatggtatagttggtccatagtctgcttattag

SEQ ID NO: 8715 - DNA, 514 bp, Homo sapiens
caagcccccgccgcacccacctccacccccccccaaaaggaaaaacaacaaggaagaacgtacccaggcagggccaccacaaaaggggagcatcaaccgagcccacgagcgggcaaagggaaacgagcggggcggggggagacggacagggcgccagacacaccaccagcagagcacagcagacgggccgaagccgggcccgggggccggcctggacacgccccccgggcgcaggaccccccgcccatgcccccgaccccgcccgccacccacgcggccggcggaccagcacagacccccaggccacggcggggaacaaaaccagcacaacccccgaggaggcagacccacaccaccgcccccaaggagcccccccggcaggcgccggccccgaccccgccaaccggcagcccgcgggcagcgaggctccaacaggcccccccacgcgacacccaccccctacaccccccaccaagcacgcagcgaaaaaacacacgccaagggagggcaagcc

SEQ ID NO: 8716 - DNA, 306 bp, Homo sapiens
ccctttctttttttttttttttttttttttttttttttttttttttttttttttttttttttaaaataaaattaaaaaccaatgaaatttattgggttacagggaataaccgggcacaaaatggtggaaaaaggggttaaaacaagtttacattaaaaatacaaacaactacggggggtgacaaatttggaagcggggggtacttaaaaaaacggcatcgaaaaacaaaccactaaaaattcgcgaaatcaaaaaaataacttctttcttctttaaaaaaggagggggaagaagtcgttgggttat

SEQ ID NO: 8717 - DNA, 194 bp, Homo sapiens
aggtaacaaggctcttttttttttcttttttttttttttttttttacccgtttaaaaataacattttttattatttccccaggcccgatccacagccctgaaacaaaagcattctgatacacatttgtcagtgctggggggtttggttgccatgactgcctacacaggcgcgatgaacagccaccccgggttgg

SEQ ID NO: 8718 - DNA, 242 bp, Homo sapiens
tgggcaaactgactggtgatggcaagagtggtgtctatgaagacggactacacagcatggcacatacaataaacactgcgagactctatgcgattacctggctactacacacatttatacccaacataacttcatgaattgatgccaccatgtgcaataaactgcgccgtctggtgctcagaggaacaccaggcgctgcaacctgcagctctatcaggacgcccagactccgccattagggg

SEQ ID NO: 8719 - DNA, 466 bp, Homo sapiens
tgctatcacaaatattctacttgtaactattcaactgcatcgctgacataacatggttgaacgattgggataatggcactaagcactaggtgtagatatgattatgactataatacatgggtaaaggtgctgataataaaacaaactctaccatactagatacactgagtcaatgtatatataatgtgggatacgataatgaactcacaactaatatggcagggacacatatatgaaacacaatatatcctgtatttgcgatataagcatcattataagatcataagtagattgtgcgaagaatcctatgtatgccggactgttttatcctgacccaacccatatgacttgtcccagtggatccgggagaagagatatgaatgacatgtagccggactgagcctacacagttacacccccgatatgaagggaacgaaaatacatcttattgcataagctccagcag

SEQ ID NO: 8720 - DNA, 450 bp, Homo sapiens
tttttttttttttttttttttttttttttttttttttttttttttttttttttttttttttttttttttttttttatttaaaagttttattataaaaacacagggaataaaggggggaatccaggttttgggaacagaaaaaaaaaagggaaaggggaccctccccataggggacacttatccttggggtaaactaaaaaaaaaaagggaaaaaacaccaaaaacaaaaaaaaagaccaaaaaaaaaataaatttaaaaaaaaaaacaggaacggggggagggagaccggggtaggggggaaaagggggcaagggaaaaacatcaaggctaggggggcctcccctgaaaaattgcgggcttggggaagtcaaggtcggtggcagggacaaacccgtgcccggcccgcgggggggaggggaggggaagggggggggggggcggggtgaggg

SEQ ID NO: 8721 - DNA, 210 bp, Homo sapiens
tgcaaatgaatgaaaatggtttaaaatagacacaagacatgggccaacatacgttctactgacgatgcagaggaactgggaccctacccagctggactgggaatgggaggggtgccgccatgctggaaagtggcgcgggagtggcttaggatgccaagtacatccttaccatgacatacaccaacgccactgatgagatgtgcacgaagg

SEQ ID NO: 8722 - DNA, 354 bp, Homo sapiens
acaagctttttttttttttttttttttttttttgctcacatttaatttttattttgattttttttaatggtgcacaacacaatatttatttcatttggttcttttatttcattttatttgtttggtgctggtggtttatttatttttactgaaagtgagagggaacttttgggggcttttttcctttttctgtaggccggcttaagctttctaaatttggaacatctaagcaagctgaaggggaaaggggggttcgcaaaaacactcgggggaagggaaagggggctttgttaatcatgccctatggggggtgagtaactggttgggccctgccgggggcgcgggggggggcgg

SEQ ID NO: 8723 - DNA, 162 bp, Homo sapiens
gttggccccgtaggttactagtctagtgtcttcagtatgtaactactgtgacctcatgctggtcaagggtctaagtttaactagcaactatgtattccagtaaaatcagatgtaaagtatactactttggtactaggtacctaagtaggtcactttcacttg

SEQ ID NO: 8724 - DNA, 354 bp, Homo sapiens
gctgcagtgacatgagacagaacagcgcggagggcgccacaaaagcagcggacaagaaagccgcaggagcaggcaaggccaccaagccagcccagaaagcccagaaggccaaacgaacaccaccccaaacaccagccaccccacacacaaacagcggaggaagaacggtctcagaaccgcaagcatcaaccggccatacaagaagagcagcaaaagacaggacaacgacaacaacgcatcgcaaaacccccagaaggaaaggagaacgccgcgaggaccaccccggcaaccccactcgcgtgcggcagcataaagccacaagtaaccaaaaccagtacgctgccgggactgcaa

SEQ ID NO: 8725 - DNA, 578 bp, Homo sapiens
ctggtctttgtgtatggttttgtgatgtaacgatctttgctggggttttttgctttgttgtgagggaaatgtcttggagtaaatgttaagttcctggagttaatgtgttttacaggaattttgttttttaaaaaaataggatcattctgaactttggaatgacccccttatatatgatctgaaaatgaaaacagttacatgaaaaaaatatccaatgaagatgtcagcattttatgaaaaaccaaaagttattagatgaaagcagcgagtgaatctttaaaacagacttgatcacgcacacacaataagtctttctctccgaaaccggaagtgaatctatatctggtagaaataatgtagccaaaagaatgtataattgaggatttttttgccaatagtttatagaaaatatatgaaccaaagtgatatgagtttgtaaaaatgtaaaatagtatgaacaaaatttgcactctaccacatttgaacatctagtgaggggcacattcatactaaggtgtgaacaatgtgtgtctttttgcactcattttttacgttttattaaaagagcaaaaaacaaa

SEQ ID NO: 8726 - DNA, 498 bp, Homo sapiens
  misc_feature (1)...(498): n = A,T,C or G
ctgatattgtgtagacgaaaagatgatctgcaagatgataaagatctggaatatggccataaactgtagaanggtggtgaagctgtcattgctgatgatgctgccgtcgagcacatgggtgctgacgagcccatatactatgcaaccttgtgacactatgcagcttcggatatgatacatacacgtgatgtgagagacacaaaagcagtggacgagatagcagcagggagacggcaaggctgccggatctggccaggacaccaagaatgctcaaagaacattatacgctatacgaatcacatcactaataaccaccggcggaataacagtcacaggagtgagaactgcaatagaacagttaggttcaataggccaatacaggttaatgataacaaagcgtcgtatgaccacaatacagaaaagaaaatgcataatgaaacgataatgttttgtggaccacgtgtggtagctttaatgcatgaggcagtaatatcagat

SEQ ID NO: 8727 - DNA, 162 bp, Homo sapiens
aatgctcaacgcattacattacatgaactcacccatgtgatggtagtaactgttcttcatcactaaaacatggaagcgaaaaatgagtcagatgctgtttcgaggctcgaacaccatcccagcaatggtagccctgcctgcaatcttcgactttaataccca

SEQ ID NO: 8728 - DNA, 258 bp, Homo sapiens
gtagagtaggacagagacaagaaaaatataatgcacacacacattggatggttgtacttgcaaactagctaataacactagggaagaacaaaggatccaaaagcaggtggagagcataaaagaacacatgaatgggaagtcctgcaagagctacatgaatatacgagatgactctataaaagctgactaatcattatgtatatgactggaatgatcaacacacagaactacatgaaactcatccattgtaggctgatc

SEQ ID NO: 8729 - DNA, 194 bp, Homo sapiens
atggatgttaattgaataatgatggtaaaagggtagattattggttgtattttgattgatgttataatgaggaggtttgtggataggagtgaataaagtgattggatgagtgggcgaaatattatgagttgatgatgggatatatggaggatggggataagtggagaggagaagatgggaaagtggagggaaaa

SEQ ID NO: 8730 - DNA, 402 bp, Homo sapiens
gtgcaccgagacgcgcggaggcagaggctcgggtgcgtgcaagacacaactacaccggtagcaccaccgacatgagccgaagaaggcatcgtgactggacgtgtaagggaggtaaacactgcgtccacaagaggatgtgaaaactgcactaaaacacagatggcacgaccacgtgaaataagatatgatgacggacacttatacaagcgacaatggcaactccgtgtactagcatcgaagtgaggaagagacgtatgtatgaacaagacagtgctggtaggacggactgagactgaacagacactatcatactatctccaagggcgatgacgacaagaaacagggagaatgagatatgacttagttaactggacagaagggggaaaacaagtatatggtcgg

SEQ ID NO: 8731 - DNA, 498 bp, Homo sapiens
  misc_feature (1)...(498): n = A,T,C or G
tacactaaatacaaagtgacaagggtgtctgtgtgctatgctcactacaacaaacccttcacctaaaaaacaaatggaagaaaaagagaaacagctgcaaatagttaaaagcactatagtaacacataacaaaatgtgagagatgagagaatagaaagagtagaaaatataactacttgctgtgaacctatggtagttacgctctgtcagtctgtagcatacataccataccatataaacacagcacaagagtaagacaacaacacatggtgaagctagactatgtgcaggatacatgatgcgtgataacatctgcaacatgagacaaacgtagaagagaactgaggcaataaataaaagtgatacctatagacggatacagtgatataacgttgggacactgggtggaagcgcgggataggagcggtatgtgcatcactgctgagcacactaatatgaatgtagtaaatggaccacgtccagggtagatgactgnag

SEQ ID NO: 8732 - DNA, 178 bp, Homo sapiens
ctgtagtttaagatgttagacaccagactctcacgcttgatccaaacatctttactcaaccacacaacaaatgaggtaatatctgtgtgtaagtttcaccttttgtcatttaccttctcctctcggtaaaaatgtaaagaaaaaagtgtatatgcttctccttgctccactgtaaata

SEQ ID NO: 8733 - DNA, 210 bp, Homo sapiens
tgttatattagtgatagatatctattatagattgtgaatcaaaattatgaatcttcagattgatgtggttgtcgtgaatatggttcagaagatgtcgataagtagtaggactgcaagtttaggttacttatgctaggactgatgtttgtttgaatatttgtaagtgcttggttattgaaagtgattgcctttaatccaagacttatagtg

SEQ ID NO: 8734 - DNA, 338 bp, Homo sapiens
aggtactttatgaatatgccagaaatatgttacataagcaattataagacgtgcaagtatggaatggattacctcgtctccgctcaaaaacactgatctctgaaggaagatggatttatatgtggatatgcaagtctgatcataaggttcattgtgagatgatggggaacatgtaacttagttatagagctaagaggagttattgtgcagtgtggagtactcaagctttcttatctagatgtactcagtcatctggctacctcggtgcgtgaaccaatctaattattaatggattagcggccgtctggaggtcgatcatataggagaagtccgtgcgc

SEQ ID NO: 8735 - DNA, 210 bp, Homo sapiens
ggcccgggggcaaggtacctaattttggctttcatggatttacatttttttaagggggcgtttaaggtgaatttattgttatttaataatgtcctggagataactttggggtataagattccaattttaatgtaattacctactattatttttgtgttgtcgttttgcaaagaaagataatgattcctgggggcttggggaaatattaat

SEQ ID NO: 8736 - DNA, 258 bp, Homo sapiens
tacagctttttttttttttttttttttttttggttttaagttttattattgaaaaaacaaaaattcaatggtttattcatgtttttggcaaaagaaaaaaacaggggacgggggaccttcccctaagggaaaattattctttgggttaaattatattaattatgggaattgaaacttattaaattaaccgggaaattaaaaagaattaattaagaaaaagggaaaggaacgggggggaaggggtcttgatttgtggga

SEQ ID NO: 8737 - DNA, 370 bp, Homo sapiens
gtatacgtgtattatttgtttttgttttgttctgtgggaatgaagaaatattttagtaaagtgtggggagcgggatgatgttcaatctcacaacttttggaaatgcttcttggtgctgtcagccgttggtgatctttatcttatttaaatgcactgtattgtgcagaggtctggtctcgcgtgttgtgaccattatttatatctggatatccctaagataggtggacaggtgtgcgtgtggtggcggtcgctctatctctgttgtggattatacgtcggatgcagatgagatatatgggtgtgctcataatgcgttggatgcataacatgagtattatataatgtaaacaaaatagcttggggtcggtat

SEQ ID NO: 8738 - DNA, 386 bp, Homo sapiens
actgcacactgatctgtaactcatcgcatgttgttattttgttttatcttcataccaggtcatattatctttatgaacagactggtgtatctactaaaaaatatatttatttctgagagctatgtttttggctgggaggagtgatatctcttcatacttaaatgttttattatatgcttaattattgtattctgggtgtttggttgtatgtacttgctgcgaggtggtgctgagatgtcactactgggtgcgccgctgcatgtcagtcgaacatatgggagagcttgcaagtcgtcggttggatagctctactattctatagtgtgaatataatagctgtctataatcgtggtcttaattgtttgctgttgtgatattgttttcct

SEQ ID NO: 8739 - DNA, 258 bp, Homo sapiens
tggcgcctcgggtagtgatccatgagaaagccatgtcagttcgaacgatagatcgttaagactcatgagagaaactgacgagtttaatctgaatctcctagttctttggagatggagatgaatcgtgaatacagctgagatctagtagatattattaggtagcaaatgaaattgtagttggtggtggttggaatgctataataatctttgttctccgtgtctcagttgaaatctttacacaaattataaggctgggtg

SEQ ID NO: 8740 - DNA, 386 bp, Homo sapiens
aggtaggagcattgtgcccattatttcttatggtcgatagagggttcagggggtgctaatacggtatataccggccgtatcttcatgatggctaaggaaagttatttgaggaatatcgagcatgaacgtgtgttttgttggggagatactgtaccattgagtgtattttactgacgcggctgtgttctgatgaaagtggttgggtatttacgtcttggaaaagtgtttgtctttcaatctgatgtgttgccagctcatatgtgcgaggtgttgtgctatgtgttcattatcagaatgggggtttccatatgccatatctgacgtggtggcctgtctatatcaatgaatgtgtcgcagctgaatgacacgttgaaaatattggagag

SEQ ID NO: 8741 - DNA, 386 bp, Homo sapiens
aaatgtttgatctgttattgaattgatctgtacagagtcatgatatttttttggtatgtatgagtaacatgaatgcttctgtatgaaacagttgttatatatactctagatttatatactaacattctggtttggctatttatgtgatattgatggtgttatatattatagtattatgtgttcattccataaattttatgaatataaattcattgatttctgtcttctatggtgatggtgggtgactagtgtttggatggagtctaatattaaatgattgtagcgattgattatgtatggaattaatatctatctcatataagacgcaaaaaaaacaaggaaagaataataccaaatgtagtggaggaagagggagggaacgaaag

SEQ ID NO: 8742 - DNA, 322 bp, Homo sapiens
gtacaagcttttttttttttttttttttttttggtttaaaatttttttattaaaaaaaaaaaaattcaatttttttatcaatttttttgcaacatataaaaatcatggacgttgaaccatcccaatagggaaatcttttctttgggttaaattattttaattatgggaaatgatatttattacaataacaaggaatttaaaaaaatataattaaaaaaaagggataggaattggggaaaggattctttattttggaggaattgtgtctcttgtaaaagcatccgggttcaggcaaccttccttgaaaatttcttgtttctaa

SEQ ID NO: 8743 - DNA, 386 bp, Homo sapiens
taggtatcgtgtgtggcgctgacgtcctcctctgaagcatgggatctctgatttgctaggtcctggttgcttcagttgcctgattagtctccgaggccgtgttagcagtcagtagatgtccgtactagatcctgtgaggtagggtggtgggtactgggagatgagtagatagagatgccagtaacatgttgtcttcctaaacaagagaggtcgggaggtatgtgtgtgggggaagtgaggagtgggtccagaaatatgtcagagagctggtgttgagtgactgatgggtataaagatgtaggtgtaagactcagggtgtcagtggggaggagcacgagcctgagctcgtggggagcatgacgtgatgatcgtcgtaggagacgtta

SEQ ID NO: 8744 - DNA, 594 bp, Homo sapiens
ggtactgattttggatttttgattttttttttgggtgtgaacttatacttgattgatatatatcatatatagataatttgaacatatgatttactatccattgtgggttgatgtatagattgtcaacttatatttggaatgtaataagtatgtattcttctgttaatgctatgttctcctggtgttcatctgacacatggaatttgtgtctgatgtgccattagagcggtgtctcatattgtccgcatatcttgatcgaggtagtgaattggatcgtatcttttgatttataagtgttcattgtatgattctgtgagttatacataccacggatgggatgttgcttatgttggctgcctatttggtctgtgagattgagcgtttttatcacatacatttgcctaatttgtcataatacaatggattagatgacacctctgtcgcgaacattcttatctgtattgtattcgtggtggacttcacgtcgaatatgtgggagatctcctatcgcgatgagatgtgtagcttgatgttgctatagcggtccctaaatggctcgacgtcatcattatcatggttgtttccagggtgtag

SEQ ID NO: 8745 - DNA, 514 bp, Homo sapiens
gcaggtactgattatggagtcaatgaatatatggaagggtcattcatgatatatgatgtaggatggtatgttttcatatggatcaacgtagaatcattcaagttatgtatggtatgctgtgtatacaatggctcatatagtgagatgatatctataaatgtatatgctgaataatattactttatgtttttatgtacattgtttgattaggtgaaataagtacataacgcatgggatcttgcgtaggtcggctgtctagatggactctgacataaagtcttgttttcggatagcatagattgattagtggcatctaataggattatctgagacagtcaggggatataggattcataaatcatacttgtatctagtcatatgcatgcttatctacacaaaagtagatattatatatacttatctgattgatgagatctctcatatctctcccatatttattatgttgtatatcaatttatggatttttatctggaatttgaagatagcacgttcg

SEQ ID NO: 8746 - DNA, 306 bp, Homo sapiens
agtgattatggaaacatgaagctatttaagggtttattacccctaaaggaatggaaagtaatctataatatggataaaagacatttattaaaaaaaataattgttgtctgtgtatagaaaagcagcttacaatgaatatgttatcaataaatatctatgcttagaaagtgcaaccttcttggtcttataaacaaaaagtgggcattggttatcctttgataacttacggccagggggttcattaggaaatccaccccatcatgatggaagtttggcggccccatcttccgttatggttaaaaaaaa

SEQ ID NO: 8747 - DNA, 430 bp, Homo sapiens
aggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccaatgcagcatatttttcatagaatatgcattgacccatggcttgtggatcaccgaacatgtccaatgtgtaaacttgatgtcatcaaagccctaggatatgggggagagcctggggatgtacctcggccggcgacacgctaatgactagt

SEQ ID NO: 8748 - DNA, 178 bp, Homo sapiens
cagtcagtttacgagtgtttctagattaggttgtataatttatgatggattggcagaggtgcatacattaaatgtaacttgttttttgtcctctcccattatacataatggagtgatgatatactgaatgtgtgggaagaataatgaaagagattgaatttctacatctagtgcatca

SEQ ID NO: 8749 - DNA, 194 bp, Homo sapiens
tactaataatggtgttggcttagctatgatggattcaacatgaaaaatgtgaagctgtgataggtcattgtaatgtaaaatttgttaagacaacaacatcagtttttgggcggatatgatatttattgtgtaaatttgctgatggaggacaggaccagagacagaatcagcaatatacatgctatagggaagga

SEQ ID NO: 8750 - DNA, 402 bp, Homo sapiens
aggtgcatgctggatgataggatgaatttgaatgaatggtatctcctgagaatgggcagacactagaacatgaccttctggacttacagactggcgatgtgaatacaaaataatgtgtcgagatgtgatcgacaatggtattccactgaggggtactacagtcagacaagatatgacgaagatgtgtgagggagtggggaggaagatgagaaagtagtggtattatccgaacacagtagaattggtgcaatttgctgatatgaaatggtggatacatgctagattcaagtgtgatgagaattggtactagggatggaaagtcactgctaagattgcaagtgagtgagagtggtgagccagatgctctggactgcgtcataacatggacttgtgcaaatgata

SEQ ID NO: 8751 - DNA, 162 bp, Homo sapiens
cagaattatataatactaatgcgtatgtgatgtgagacggtagctgctgtcagacggcatcactgtgaattcagatgcaaagaggaactgttgatcttgatgcccatacctctgatcagaatcttgacatactgtcatgagacactatagggtacgttatca

SEQ ID NO: 8752 - DNA, 194 bp, Homo sapiens
agataactatgggttaaaagagagagtggattttttatacatgattggatacagtgggattgaccatcagctgactaggagataatataacaggctgttgaaagtgattgttttttgaagatagaggatatgagattttctgctgatcttataatggtgtgatgtctgatatcttgtgttcgctgttattgtta

SEQ ID NO: 8753 - DNA, 162 bp, Homo sapiens
acacactgccactggcttttgctgtccacggccatgacagaccgacgcagcgagctttctctcaaaagcaatgcttaaattttattcataatatactgactgcaacaacatcatgaaaatacaaaaaaaaaaaaaaaaaagacttgtacatgaacagaggcg

SEQ ID NO: 8754 - DNA, 466 bp, Homo sapiens
ggtcatacaaagagggcactacaccagcttcttggcctcaaagaagctcttgaggtgacgcatctgccagatgccagtgaggatgaggatgacagtctgagcaatggaccaccataggtacctctggttggtgctctcgctcgtcagtcggaagcgctcttcacgatacctttggtaatcctgctccttctgaatctgttccacctgatcaagcaactggcgggagcggagctgtagctccgacagattatcttttgaagaaatctcagggtagtagtaggaatgctccccaaactggatgtagagatgacaccgaagtttgacaacagagaagagagccatcctgatagaataggagtgaagacagatatgatggtcaccgggagtgtgggaggtgaaagtgaagaggaactcagagcagataatgaccgggaggaagaacgaaataaatagagaataagaagac

SEQ ID NO: 8755 - DNA, 496 bp, Homo sapiens
gagtgagcctcctcacccctctctgctctgctgatgggggcttttggacagcaaggcatagagcagaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtgtggagatcatccaggttgagagggagaagagtggattaaagacagtcagtgggattaagtgtctaccctgaccttgcttctctacatttccttttcatcttgaaagaagttggaggtggcaaaaatattaagaaggtggatcagaatgacttggggactgaaatttgtgagggaagagacaggctgtgcaccttctagaatggatttatctcttttatgactaccaagaaggga

SEQ ID NO: 8756 - DNA, 258 bp, Homo sapiens
cataggtgcttactatactgttttgtttctgaatttggaatttctcaaaattaaaaaaatatctactgaggagcttttcgttttaactggtggggaatgggttctgggtggttttgccccttgtttttttagattcaagaaatccatggtgaaaggtttggtattctatgaagaataggaggataaagtgatcaaggagatggcagctcagatgcgcgaggtggagcagagccgacaggaagtgggcgtgtccgctct

SEQ ID NO: 8757 - DNA, 551 bp, Homo sapiens
  misc_feature (1)...(551): n = A,T,C or G
aggtacacattgccatgagatggcactttctgaggatactcactaaaactgagtttcttcattagaaaaatctcactttttatcatcatctcagtgcctggtattggtgcccttangtctgtgaacagcattgcgttatgccagtaaatgaatacttaaatcaataattgcattctcagcagtcctcttagtctttgtttgtttgtttgtttttcacagttgaattgcaatgtagctgtttggcagaggcattaacatttttgccctaaccctggcctggtgcctangctcaggggagtaaaattagagccaggagccagngagctgaggagaccacttaaaaggcatgctagcatttgataagtaaggggttactttgtgaggaaaagaaactttatatgctttaagcaagcctctttatgaggaagaaaaggtcagctactgaagcggggtcccaactactgctgggtctgtagaggagagagacacccccaaaatccagatgttttagttaacaatcagacacagacttgtctctggtttcttacagg

SEQ ID NO: 8758 - DNA, 466 bp, Homo sapiens
  misc_feature (1)...(466): n = A,T,C or G
cgggncagnntacatggntgnantggagncctnncctccacccctctctggctctgnctgnnatgggggncttttggnacagccaaggncataggancaggaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtggggagaatatccaggttgagagggagaaaaatggattaaaggacaagcagggggattaaatgtttaacctgaccttggttgtgtatattttgttttgaattagaaagaaattggtggtgggaaaaatattaggaagggtgaacagaaagacatgggggcaggcatatgt

SEQ ID NO: 8759 - DNA, 450 bp, Homo sapiens
tgatttctaaagtaagcctcagaatttccaaaccaattcatccacagctgtttctgggctggttttaaagtagctgctacagaatcatgaggctttccctttttatcaaatacgaaaaacatttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctgggggctcactttctcccaggattgtgggcttctctggaagtgaagggtgaggaatgagtggggtgtcgagcccagccctggctgcctgtgggtttgggggagggagcgagggatgaggtgccctggcagatggca

SEQ ID NO: 8760 - DNA, 530 bp, Homo sapiens
gcagcttccccgagctgatgccattcgttcacgtctcatcgatactttctctctcatcgagcatttgcaaggcttgagccaagctgtgctgcgacacactatcaggagttacttgatccttcccgccagaagaaacttatgttgggagatcaacaccagctagtgggcgtctctataaagcctcaacgtatagaacagatttcacatgcccagaggctgttgagcaggcttcatgtgcgctgcagtcagaggccacctctttctttgtgggccggatgggtccttgagtgtatcctttcatgtcactcatttttatcctggctgttgatcatctgcctaatgaattattttttgcttcccaaactccattgtctcattctcaatgcttatgttattgctcttattatttccgctgcataaatcagaaagaactcaaaaaaaaaaaaaaaaaaaaaattggggggcggaagcttattccctttagtgaaggttaattaaagcttgggactggccggaggtgtacaaagtcg

SEQ ID NO: 8761 - DNA, 690 bp, Homo sapiens
  misc_feature (1)...(690): n = A,T,C or G
taagcgtgtccagaattggtgggtctcactgacttcaagaatgaagccgcggaccctcctggcggaattctccacgagttttgagcagcctcggttttcccaccacctccaaatcatgcaagacacagggtaagagcaaagacaatgtggctgtggccgatgtccaccctctcggggcgtcccttctcttctctcctccttgagcagggagaccatcggggtgcaacctggttggggcggggaggaggtgcagggcctggccagagcgggcctggccacgggcaagggacagcgacccccgggccaggacaggtgagagcggcgcaggcccgggcccggcgtggcggaggtgcgcgtgagcggncagcagagggcgccagagagccaggagcggcccgcagaggagcccgcgccggccccggtgcccacctccgcgccgcgcggaccctccgagcccgcgctcagacgccccagctccgccgagagggcgcttgcgccgggtccttctcccccaaatgcaggcagagcccccggagccatgggcaggccttccggcagctccaaagccactggcaagccccgaaggcaggatggccggcccaggagggaggaggacgacgtcccctcccgaagagaagaagctgcggctcttgctggtaggggggaagcgcacagccccaggaactggaa

SEQ ID NO: 8762 - DNA, 418 bp, Homo sapiens
atagattttcaaaatgtctaaaaagtgcagtttgaattgttacatgttaatacacagttgctttattcagatgtgtttgtgttgacggactaacagtgccttctggatctgtgcaaataatggtacccctccctgcaaagaaaaaaagagtcattaaagcactacaatattacacataaactgatccatctaggtcagctttagtcaggaccggagaatcagcaaacataagaaaaacaaaacctaggaatacatacaaaagctctcatggggtgctagaaccctcttagactggtgatgtatgtggagggcattaagagctggaaaggcgtatatgggtaactaccgttaactatattctacagcaagggctgggggggcagaacaaggtgaaggtgggtggttattagggttggga

SEQ ID NO: 8763 - DNA, 632 bp, Homo sapiens
aatgaatgaaaataaagttttacctcccaagtcaatttcacataattctaattccttttaactagagaatatcttgtttagaaggatcattaagctaggtcaaggtaaaaaacaggttataagacaaatgcatatgaaatctacaacttataaggaaagaaaataccaaattagttctatcagtcctctaaactacagaagaacattatttttacctagtgtgcatgtacacacacacacacacacacacacacaaatatttaatgcttttaagtacatttttaaaaaaaatctaaacaatactttgactagtcttttcctcctaatattatatatagactgaagtttttgaaaataaaagtagctgagccaatgaaatgctttagcattgtatttttaccatcaagcactgtttagcaggctgtatttcccacttttcttcattgatatcaggagcaagcactagaaatatagaaaataaatataaaataatcacaagttcttaaccttatttttttcagtctttatcagcttcacgtagagagctgctcactgtgttatagcactttttaagttgcaaagccttgtcatatacattataatttgtattcctctaagcaagtcaaggggcg

SEQ ID NO: 8764 - DNA, 450 bp, Homo sapiens
tgcagacctcggaagggagcggatagcggcacccggagccgcccgcagagcaaagcgcggggaaccaaggagacgctcctggcactgcagataacttgtctgcatttcaagaacaaactaccagagaccttacctgttcacttggctctcccaaccaatggagatggctccaatggtggcacaaaccagggaagggaaatctgaggtttaattcctttatgcctcattctctgagtgctgaaggcttgctgtaggcctgtatgcctgttaaatgctaaattgtgataggggtttttgccttccaatgaactcccacatatttacattttaccagtgtatgatgccctgttactagcattgacatgggaacaaaattgctgccggggggaggatgaacaaagaaagtcatgaagttaccccttgtctgggataaaactatagtactttcaa

SEQ ID NO: 8765 - DNA, 562 bp, Homo sapiens
  misc_feature (1)...(562): n = A,T,C or G
ggggtaccattttacacacctccgncggtggnaaatccttgnaaagnaaagcagcaccagctgctgactgcaggcctctctgccacctctgcctgcccgcctcactgactgcttcatctgccagcctcgcatgcacttctgacaacacacctgtccatcacagacactgccagctgctctgtgtgtatccatgtgtgtgagccagtggtgctggcgggcagcggaacgatcgtccgtgatgctagaccgaacatgcacgggcacgcatctcctggcgtgtgagtggaggctgtcagaggggcggacgggagtgagggcatgtgtctgcatgggactgatagggacagagaaacagtggcagacttgggcgatacatagctcaccagacaaacatgcaccgtcagatagatagagggtagaaagatcagggagaagagagagcccagcaaacatgcacaccangcagtggcgggagaggcacgctcactacataggaagaatgaacagacggcacacgcacgcagggcatggactgcagcacatctaaccaaccatgcctaga

SEQ ID NO: 8766 - DNA, 594 bp, Homo sapiens
  misc_feature (1)...(594): n = A,T,C or G
cattgccatgagatggcactttctgaggatactcactaaaactgagtttcttcattagaaaaatctcactttttatcatcatctcagtgcctggtattggtgcccttangtctgtgaacagcattgcgttatgccagtaaatgaatacttaaatcaataattgcattctcagcagtcctcttagtctttgtttgtttgtttgtttttcacagttgaattgcaatgtagctgtttggcagaggcattaacatttttgccctaaccctggcctggtgcctangctcnagggagtaaaattagagccaggagccaggangctgaggagaccacttaaaaggcatgctagcatttgataagtaaggggttactttgtgaggaaaagaaacttttatatgctttangcaagcctctttatgangaagaaaaagtcagctactgaacggggtcccaactactgctgggtttgtagaggagagagacacccccataatccagaggttcagttaacaatcagacacagacttgtctctggtttcttacagggtgacagcagtattcgctattttgagatcaccgatgaaaaccccggcaccc

SEQ ID NO: 8767 - DNA, 754 bp, Homo sapiens
  misc_feature (1)...(754): n = A,T,C or G
actatatttaggcaccactgccataaactaccaaaaaaaaaatgtaattcctagaagctgtgaagaatagtagtgtagctaagcacggtgtgtggacagtgggacatctgccacctgcagtaggtctctgcactcccaaaagcaaattacattggcttgaacttcagtatgcccggttccaccctccagaaacttttgtgttctttgtatagaatttaggaacttctgagggccacaaatacacacattaaaaaaggtagaatttttgaagataagattcttctaaaaaagcttcccaatgcttgagtagaaagtatcagtagaggtatcaagggaggagagactaggtgaccactaaactccttcagactcttaaaattacgattcttttctcaaaggggaagaacgtcagtgcagcgatcccttcacctttagctaaagaattggactgtgctgctcaaaataaagatcagttggaggtangatgtccaagactgaaggtaaaggactagtgcaaactgaaagtgatggggaaacagacctacgtatggaagccatgtagtgttcttcacaggctgctgttgactgaaattcctatcctcaaattactctagactgaagctgcttcccttcagtgagcagcctctccttccaagattctggaaagcacacctgactccaaacaaagacttagagccctgtgtcagtgctgctgctgcttttaccagattctctaaccttccgggtagaagag

SEQ ID NO: 8768 - protein, 730 aa, Homo sapiens [sequence omitted]

SEQ ID NO: 8769 - DNA, 674 bp, Homo sapiens
  misc_feature (1)...(674): n = A,T,C or G
  misc_feature (477)..(538): Masked repetitive sequence
taaaagcaggctgtgcactagggacctagtgaccttactagaaaaaactcaaattctctgagccacaagtcctcatgggcaaaatgtagataccaccacctaaccctgccaatttcctatcattgtgactatcaaattaaaccacaggcaggaagttgccttgaaaactttttatagtgtatattactgttcacatagatnagcaattaactttacatatacccgtttttaaaagatcagtcctgtgattaaaagtctggctgccctaattcacttcgattatacattaggttaaagccatataaaagaggcactacgtcttcggagagatgaatggatattacaagcagtaatgttggctttggaatatacacataatgtccacttgacctcatctatttgacacaaaatgtaaactaaattatgagcatcattagataccttggccttttcaaatcacacagggtcctagatctnnnnnnnnnnnnnnnnnnnnnnnnnnnnnnnnnnnnnnnnnnnnnnnnnnnnnnnnnnnnnnactttgggattcctatatctttgtcagctgtcaacttcagtgttttcaggttaaattctatccatagtcatcccaatatacctgctttagatgatacaaccttcaaaagatccgctcttcctcgtaaaaagtggag

SEQ ID NO: 8770 - DNA, 1010 bp, Homo sapiens
  misc_feature (1)...(1010): n = A,T,C or G
cggacaggtacctaaaagcaggctgtgcactagggacctagtgaccttactagaaaaaactcaaattctctgagccacaagtcctcatgggcaaaatgtagataccaccacctaaccctgccaatttcctatcattgtgactatcaaattaaaccacaggcaggaagttgccttgaaaactttttatagtgtatattactgttcacatagatnagcaattaactttacatatacccgtttttaaaagatcagtcctgtgattaaaagtctggctgccctaattcacttcgattatacattaggttaaagccatataaaagaggcactacgtcttcggagagatgaatggatattacaagcagtaattttggctttggaatatacacataatgtccacttgacctcatctatttgacacaaaatgtaaactaaattatgagcatcattagataccttgggccttttcaaatcacacagggtcctagatctgnnnnnnnnnnnnnnnnnnnnnnnnnnnnnnnnnnnnnnnnnnnnnnnnnnnnnnnnnnnnnactttggattcttatatctttgtcagctgtcaacttcagtgttttcaggntaaattctatccatagtcatcccaatatacctgctttagatgatacaaacttcaaaagatccggctctccctcgtaaaacgtggaggacagacatcaagggggttttctgagtaaagaaaggcaaccgctcggcaaaaactcaccctggcacaacaggancgaatatatacagacgctgattgagcgttttgctccatcttcacttctgttaaatgaagacattgatatctaaaatgctatgagtctaactttgtaaaattaaaatagatttgtagttatttttcaaaatgaaatcgaaaagatacaagttttgaaggcagtctctttttccaccctgcccctctagtgtgttttacacacttctctggccactccaacagggaagctggtccagggccattatacagg

SEQ ID NO: 8771 - DNA, 21 bp, Human cytomegalovirus
atgtggccgcttctgaaaaac

SEQ ID NO: 8772 - DNA, 19 bp, Human cytomegalovirus
tcatggggtggggacgggg

SEQ ID NO: 8773 - DNA, 20 bp, Human cytomegalovirus
gtacgcgctgctgggtcatg

SEQ ID NO: 8774 - DNA, 21 bp, Human cytomegalovirus
tcataccccgctgaggttatg

SEQ ID NO: 8775 - DNA, 20 bp, Human cytomegalovirus
cacggacgacgacgctgacg

SEQ ID NO: 8776 - DNA, 21 bp, Human cytomegalovirus
gtacggcagaaaagccggctc

SEQ ID NO: 8777 - DNA, 22 bp, Human cytomegalovirus
caccaaagacacgtcgttacag

SEQ ID NO: 8778 - DNA, 22 bp, Human cytomegalovirus
tcagacgttctcttcttcgtcg

SEQ ID NO: 8779 - DNA, 21 bp, Human cytomegalovirus
cagcggcgctcaacatttcac

SEQ ID NO: 8780 - DNA, 22 bp, Human cytomegalovirus
tcagcatgtcttgagcatgcgg

SEQ ID NO: 8781 - DNA, 21 bp, Human cytomegalovirus
cctccccaactactactaccg

SEQ ID NO: 8782 - DNA, 23 bp, Human cytomegalovirus
ttactcgagcttattgagcgcag

SEQ ID NO: 8783 - DNA, 20 bp, Human cytomegalovirus
cacgtcgggcgttatgacac

SEQ ID NO: 8784 - DNA, 21 bp, Human cytomegalovirus
tcaacctcggtgctttttggg

SEQ ID NO: 8785 - DNA, 20 bp, Human cytomegalovirus
ctgtctgctcattctggcgg

SEQ ID NO: 8786 - DNA, 21 bp, Human cytomegalovirus
ttactcggggaacagttggcg

SEQ ID NO: 8787 - DNA, 20 bp, Human cytomegalovirus
atgatgaccgaccgcacgga

SEQ ID NO: 8788 - DNA, 21 bp, Human cytomegalovirus
tcacggtggctcgatacactg

SEQ ID NO: 8789 - DNA, 23 bp, Human cytomegalovirus
aagcttccttacagcataactgt

SEQ ID NO: 8790 - DNA, 27 bp, Human cytomegalovirus
ccttataacatgtattttgaaaaattg

SEQ ID NO: 8791 - DNA, 21 bp, Human cytomegalovirus
atgatacacgactaccactgg

SEQ ID NO: 8792 - DNA, 22 bp, Human cytomegalovirus
ttacgagcaagagttcatcacg

SEQ ID NO: 8793 - DNA, 19 bp, Human cytomegalovirus
ctgcgtgtcctcgctgggt

SEQ ID NO: 8794 - DNA, 21 bp, Human cytomegalovirus
tcacgagtccactcggaaagc

SEQ ID NO: 8795 - DNA, 20 bp, Human cytomegalovirus
ctcgtcttcttcggctccac

SEQ ID NO: 8796 - DNA, 22 bp, Human cytomegalovirus
ttaatcgtcgaaaaacgccgcg

SEQ ID NO: 8797 - DNA, 21 bp, Human cytomegalovirus
gatgcttgtaacgaaggcgtc

SEQ ID NO: 8798 - DNA, 22 bp, Human cytomegalovirus
ttactgagacttgttcctcagg

SEQ ID NO: 8799 - DNA, 21 bp, HHuman cytomegalovirus
gtagcctacactttggccacc

SEQ ID NO: 8800 - DNA, 22 bp, Human cytomegalovirus
ttactggtcagccttgcttcta

SEQ ID NO: 8801 - DNA, 18 bp, Human cytomegalovirus
acgtccctggtagacggg

SEQ ID NO: 8802 - DNA, 24 bp, Human cytomegalovirus
ttataagaaaagaagcacaagctc

SEQ ID NO: 8803 - DNA, 28 bp, Human cytomegalovirus
atgtattgttttctttttttacagaaag

SEQ ID NO: 8804 - DNA, 27 bp, Human cytomegalovirus
ttatattattatcaaaacgaaaaacag

SEQ ID NO: 8805 - DNA, 22 bp, Human cytomegalovirus
cttctcctttccttaatctcgg

SEQ ID NO: 8806 - DNA, 20 bp, Human cytomegalovirus
ctatacggagatcgcggtcc

SEQ ID NO: 8807 - DNA, 22 bp, Human cytomegalovirus
atgcatacatacacgcgtgcat

SEQ ID NO: 8808 - DNA, 22 bp, Human cytomegalovirus
ctaccatataaaaacgcagggg

SEQ ID NO: 8809 - DNA, 20 bp, Human cytomegalovirus
atgaaagcaagaggcagccg

SEQ ID NO: 8810 - DNA, 23 bp, Human cytomegalovirus
tcataaggtaacgatgctacttt

SEQ ID NO: 8811 - DNA, 21 bp, Human cytomegalovirus
atggactggcgatttacggtt

SEQ ID NO: 8812 - DNA, 22 bp, Human cytomegalovirus
ctacattgtgccatttctcagt

SEQ ID NO: 8813 - DNA, 23 bp, Human cytomegalovirus
atgaacaatctctggaaagcctg

SEQ ID NO: 8814 - DNA, 22 bp, Human cytomegalovirus
tcagcacacgaaaaaccgcatc

SEQ ID NO: 8815 - DNA, 21 bp, Human cytomegalovirus
atgaagccggtgttggtgctc

SEQ ID NO: 8816 - DNA, 22 bp, Human cytomegalovirus
ttaaataaatcgcagacgggcg

SEQ ID NO: 8817 - DNA, 22 bp, Human cytomegalovirus
atggatctcttgattcgtctcg

SEQ ID NO: 8818 - DNA, 22 bp, Human cytomegalovirus
tcaggagccacaacgtcgaatc

SEQ ID NO: 8819 - DNA, 20 bp, Human cytomegalovirus
cgcaaaacgctactggctcc

SEQ ID NO: 8820 - DNA, 22 bp, Human cytomegalovirus
tcaccactggtccgaaaacatc

SEQ ID NO: 8821 - DNA, 20 bp, Human cytomegalovirus
tacggctggtccgtcatcgt

SEQ ID NO: 8822 - DNA, 22 bp, Human cytomegalovirus
ttacaacaagctgaggagactc

SEQ ID NO: 8823 - DNA, 26 bp, Human cytomegalovirus
atgaccacctctacaaataatcaaac

SEQ ID NO: 8824 - DNA, 22 bp, Human cytomegalovirus
gtagaaacaagcgttgagtccc

SEQ ID NO: 8825 - DNA, 19 bp, Human cytomegalovirus
cgttgcggtgtctcagtcg

SEQ ID NO: 8826 - DNA, 21 bp, Human cytomegalovirus
tcatgctgtggtaccaggata

SEQ ID NO: 8827 - DNA, 5252 bp, Homo sapiens
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatatgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcttgccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagttccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctggatccatgggcatacctgtgttcgaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttggttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggaactctgtgtatgaatcctgattttaactgctaggattcagctaaatttctgagctttatgatctgtggaaatttggaatgaaatcgaattcattttgtacatacatagtatattaaaactatataatagttcatagaaatgttcagtaatgaaaaaatatatccaatcagagccatcccgaaaaaaaaaaaaaaa

SEQ ID NO: 8828 - DNA, 5252 bp, Homo sapiens
  misc_feature (1)...(5252): n = A,T,C or G
  misc_feature (3967)..(3988): Masked repetitive sequence from Repeat Masker
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatatgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacnnnnnnnnnnnnnnnnnnnnnngtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcttgccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagttccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctggatccatgggcatacctgtgttcgaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttggttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggaactctgtgtatgaatcctgattttaactgctaggattcagctaaatttctgagctttatgatctgtggaaatttggaatgaaatcgaattcattttgtacatacatagtatattaaaactatataatagttcatagaaatgttcagtaatgaaaaaatatatccaatcagagccatcccgaaaaaaaaaaaaaaa

SEQ ID NO: 8829 - DNA, 841 bp, Homo sapiens
ttttttttttttttcttaaatagcatttattttctctcaaaaagcctattatgtactaacaagtgttcctctaaattagaaaggcatcactactaaaattttatacatattttttatataagagaaggaatattgggttacaatctgaatttctctttatgatttctcttaaagtatagaacagctattaaaatgactaatattgctaaaatgaaggctactaaatttccccaagaatttcggtggaatgcccaaaaatggtgttaagatatgcagaagggcccatttcaagcaaagcaatctctccaccccttcataaaagatttaagctaaaaaaaaaaaaaaaagaagaaaatccaacagctgaagacattgggctatttataaatcttctcccagtcccccagacagcctcacatgggggctgtaaacagctaactaaaatatctttgagactcttatgtccacacccactgacacaaggagagctgtaaccacagtgaaactagactttgctttcctttagcaagtatgtgcctatgatagtaaactggagtaaatgtaacagtaataaaacaaattttttttaaaaataaaaattatacctttttctccaacaaacggtaaagaccacgtgaagacatccataaaattaggcaaccagtaaagatgtggagaaccagtaaactgtcgaaattcatcacattattttcatactttaatacagcagctttaattattggagaacatcaaagtaattaggtgccgaaaaacattgttattaatgaagggaacccctgacgtttgaccttttctgtaccatctatagccctggacttga

SEQ ID NO: 8830 - DNA, 841 bp, Homo sapiens
  misc_feature (1)...(841): n = A,T,C or G
  misc_feature (94)..(121): Masked repetitive sequence
  misc_feature (569)..(604): Masked repetitive sequence
ttttttttttttttcttaaatagcatttattttctctcaaaaagcctattatgtactaacaagtgttcctctaaattagaaaggcatcactacnnnnnnnnnnnnnnnnnnnnnnnnnnnngagaaggaatattgggttacaatctgaatttctctttatgatttctcttaaagtatagaacagctattaaaatgactaatattgctaaaatgaaggctactaaatttccccaagaatttcggtggaatgcccaaaaatggtgttaagatatgcagaagggcccatttcaagcaaagcaatctctccaccccttcataaaagatttaagctaaaaaaaaaaaaaaaagaagaaaatccaacagctgaagacattgggctatttataaatcttctcccagtcccccagacagcctcacatgggggctgtaaacagctaactaaaatatctttgagactcttatgtccacacccactgacacaaggagagctgtaaccacagtgaaactagactttgctttcctttagcaagtatgtgcctatgatagtaaactggagtaaatgtaacagnnnnnnnnnnnnnnnnnnnnnnnnnnnnnnnnnnnncctttttctccaacaaacggtaaagaccacgtgaagacatccataaaattaggcaaccagtaaagatgtggagaaccagtaaactgtcgaaattcatcacattattttcatactttaatacagcagctttaattattggagaacatcaaagtaattaggtgccgaaaaacattgttattaatgaagggaacccctgacgtttgaccttttctgtaccatctatagccctggacttga

SEQ ID NO: 8831 - DNA, 63 bp, Artificial Sequence
  T7T24 Primer
ggccagtgaattgtaatacgactcactatagggaggcggtttttttttttttttttttttttt

SEQ ID NO: 8832 - DNA, 1010 bp, Homo sapiens; identical to SEQ ID NO: 8770
  misc_feature (1)...(1010): n = A,T,C or G
  misc_feature (491)..(551): Masked repetitive sequence

We claim:

1. A method of treating a patient, said patient having tissue in or near a target area of a disease, with an autologous therapeutic cell population expanded in autologous medium comprising:
    selecting a patient having a disease selected from the group consisting of: heart failure, myocardial ischemia, and Crohn's disease;
    harvesting blood from the selected patient in two visits separated between one and three weeks;
    harvesting bone marrow cells from the selected patient;
    forming a culture medium from said blood that contains no animal serum and comprises 10% autologous serum obtained from the patient;
    expanding a population of mesenchymal stem cells from the bone marrow cells in the culture medium; and injecting the expanded mesenchymal stem cells into the tissue of the selected patient in or near the target area of the disease;
    thereby ameliorating the effect of the disease.

2. The method of claim 1 where the injection into the tissue is performed through a catheter having a penetrating needle tip for insertion into target tissues in fluid communication with a fluid port on the proximal end of said catheter.

3. The method of claim 1, wherein the population of mesenchymal stem cells is phenotypically characterized by the presence of the following surface markers: CD105, CD73 and CD90.

4. The method of claim 1, wherein the population of mesenchymal stem cells is phenotypically characterized by the absence of the following surface markers: CD34 and CD45.

5. The method of claim 1, wherein the population of mesenchymal stem cells is phenotypically characterized by the presence of the following surface markers: CD105, CD73, and CD90, and the absence of CD34 and CD45.

6. The method of claim 5, wherein the expanded mesenchymal stem cells are injected interstitially into the target areas through a disposable single use catheter having a distal penetrating needle tip for insertion into target areas in fluid communication with a fluid port on the proximal end of said catheter and in which the expanded mesenchymal stem cells are delivered at a concentration of between 20M and 40M cells per cc at a dosage of between 20M and 200M cells total.

7. The method of claim 1, wherein the expanded mesenchymal stem cells are injected into the target areas at a dosage of between 20M and 200M cells total.

8. The method of claim 1, wherein the expanded mesenchymal stem cells are injected into the target areas at a concentration of between 20M and 40M cells per cc at a dosage of between 20M and 200M cells total.

9. The method of any one of claims 7 to 8, wherein the expanded mesenchymal stem cells are injected interstitially into the target areas through a catheter.

10. The method of any one of claims 7 to 8, wherein the expanded mesenchymal stem cells are injected interstitially into the target areas through a catheter having a distal penetrating needle tip for insertion into target areas in fluid communication with a fluid port on the proximal end of said catheter.

* * * * *